United States Patent
Laplaza et al.

(10) Patent No.: US 9,909,151 B2
(45) Date of Patent: Mar. 6, 2018

(54) BIOLOGICAL METHODS FOR PREPARING A FATTY DICARBOXYLIC ACID

(71) Applicant: VERDEZYNE, INC., Carlsbad, CA (US)

(72) Inventors: Jose Laplaza, Carlsbad, CA (US); Tom Beardslee, Carlsbad, CA (US); Dudley Eirich, Carlsbad, CA (US); Stephen Picataggio, Carlsbad, CA (US)

(73) Assignee: Verdezyne, Inc., Carlsbad, CA (US)

( * ) Notice: Subject to any disclaimer, the term of this patent is extended or adjusted under 35 U.S.C. 154(b) by 0 days.

(21) Appl. No.: 14/654,442

(22) PCT Filed: Dec. 19, 2013

(86) PCT No.: PCT/US2013/076664
§ 371 (c)(1),
(2) Date: Jun. 19, 2015

(87) PCT Pub. No.: WO2014/100461
PCT Pub. Date: Jun. 26, 2014

(65) Prior Publication Data
US 2016/0298145 A1    Oct. 13, 2016

Related U.S. Application Data

(60) Provisional application No. 61/739,656, filed on Dec. 19, 2012.

(51) Int. Cl.
| | | |
|---|---|---|
| *C12N 1/00* | (2006.01) | |
| *C12P 21/06* | (2006.01) | |
| *C12N 15/74* | (2006.01) | |
| *C12N 15/00* | (2006.01) | |
| *C12P 7/46* | (2006.01) | |
| *C12P 7/44* | (2006.01) | |
| *C07H 21/04* | (2006.01) | |
| *C07K 1/00* | (2006.01) | |
| *C12N 15/52* | (2006.01) | |
| *C12N 15/81* | (2006.01) | |

(52) U.S. Cl.
CPC ............. *C12P 7/44* (2013.01); *C12N 15/52* (2013.01); *C12N 15/81* (2013.01)

(58) Field of Classification Search
CPC ........... C12N 15/52; C12N 15/81; C12P 7/44
USPC ... 435/254.11, 254.21, 254.22, 254.23, 69.1, 435/471, 476, 483, 440, 145, 142; 536/23.1, 23.2; 530/350
See application file for complete search history.

(56) References Cited

U.S. PATENT DOCUMENTS

| | | | |
|---|---|---|---|
| 4,683,195 A | 7/1987 | Mullis et al. | |
| 4,683,202 A | 7/1987 | Mullis | |
| 4,965,188 A | 10/1990 | Mullis et al. | |
| 5,232,841 A | 8/1993 | Hashimoto et al. | |
| 5,268,273 A | 12/1993 | Buckholz | |
| 5,389,529 A | 2/1995 | Panayotatos et al. | |
| 5,470,719 A | 11/1995 | Meng et al. | |
| 5,595,899 A | 1/1997 | Sato et al. | |
| 5,648,247 A | 7/1997 | Picataggio et al. | |
| 5,656,493 A | 8/1997 | Mullis et al. | |
| 5,712,114 A | 1/1998 | Mankovich et al. | |
| 5,766,891 A | 6/1998 | Shuman | |
| 5,846,818 A | 12/1998 | Robinson et al. | |
| 5,888,732 A | 3/1999 | Hartley et al. | |
| 5,932,474 A | 8/1999 | Tsien et al. | |
| 6,008,378 A | 12/1999 | Tsien et al. | |
| 6,054,271 A | 4/2000 | Tsien et al. | |
| 6,143,557 A | 11/2000 | Hartley et al. | |
| 6,171,861 B1 | 1/2001 | Hartley et al. | |
| 6,270,969 B1 | 8/2001 | Hartley et al. | |
| 6,277,608 B1 | 8/2001 | Hartley et al. | |
| 6,288,302 B1 | 9/2001 | Yu et al. | |
| 6,451,569 B1 | 9/2002 | Tsien et al. | |
| 6,720,140 B1 | 4/2004 | Hartley et al. | |
| 8,241,879 B2* | 8/2012 | Picataggio | ........... C12N 9/0006 435/145 |
| 8,343,752 B2* | 1/2013 | Picataggio | ............. C12N 9/001 435/142 |
| 8,597,923 B2* | 12/2013 | Ness | ................... C12N 9/0006 435/134 |
| 2002/0007051 A1 | 1/2002 | Cheo et al. | |
| 2003/0083373 A1 | 5/2003 | Tsien et al. | |
| 2004/0265980 A1* | 12/2004 | Zhang | ................... C12N 15/81 435/134 |
| 2005/0112590 A1 | 5/2005 | Boom et al. | |
| 2005/0287592 A1 | 12/2005 | Kless | |

(Continued)

FOREIGN PATENT DOCUMENTS

| | | |
|---|---|---|
| DE | 20071019184 | 10/2008 |
| EP | 2294407 A2 | 3/2011 |

(Continued)

OTHER PUBLICATIONS

Broun et al., Catalytic plasticity of fatty acid modification enzymes underlying chemical diversity of plant lipids. Science, 1998, vol. 282: 1315-1317.*
Chica et al., Semi-rational approaches to engineering enzyme activity: combining the benefits of directed evolution and rational design. Curr. Opi.*
Devos et al., Practical limits of function prediction. Proteins: Structure, Function, and Genetics. 2000, vol. 41: 98-107.*
Klein et al., Investigation of the impact of MIG1 and MIG2 on the physiology of *Saccharomyces cerevisiae* . J. Biotechnol., 1999, vol. 68: 197-212.*
Kisselev L., Polypeptide release factors in prokaryotes and eukaryotes: same function, different structure. Structure, 2002, vol. 10: 8-9.*
Seffernick et al., Melamine deaminase and Atrazine chlorohydrolase: 98 percent identical but functionally different. J. Bacteriol., 2001, vol. 183 (8): 2405-2410.*

(Continued)

*Primary Examiner* — Ganapathirama Raghu
(74) *Attorney, Agent, or Firm* — Wilson Sonsini Goodrich & Rosati

(57) ABSTRACT

Provided are engineered microorganisms capable of producing fatty dicarboxylic acids and products expressed by such microorganisms. Also provided are biological methods for producing fatty dicarboxylic acids.

17 Claims, 32 Drawing Sheets

(56) References Cited

U.S. PATENT DOCUMENTS

| | | |
|---|---|---|
| 2007/0027309 A1 | 2/2007 | Weinstock et al. |
| 2010/0041115 A1 | 2/2010 | Nicaud et al. |
| 2010/0285545 A1 | 11/2010 | Gross et al. |
| 2010/0291653 A1 | 11/2010 | Jon et al. |
| 2011/0118433 A1 | 5/2011 | Poetter et al. |
| 2011/0129885 A1 | 6/2011 | Lang et al. |
| 2012/0077237 A1 | 3/2012 | Picataggio et al. |
| 2012/0077252 A1 | 3/2012 | Stephen et al. |

FOREIGN PATENT DOCUMENTS

| | | |
|---|---|---|
| EP | 2427559 A2 | 3/2012 |
| WO | WO-9106660 A1 | 5/1991 |
| WO | WO-9114781 A1 | 10/1991 |
| WO | WO-96194970 A1 | 6/1996 |
| WO | WO-9826079 A1 | 6/1998 |
| WO | WO-9856943 A1 | 12/1998 |
| WO | WO-03100013 A2 | 12/2003 |
| WO | WO-2004013336 A2 | 2/2004 |
| WO | WO-2009011974 A1 | 1/2009 |
| WO | WO-2011003034 A2 | 1/2011 |
| WO | WO-2012094425 A2 | 7/2012 |
| WO | WO-2013006730 A2 | 1/2013 |
| WO | WO-2013006733 A2 | 1/2013 |

OTHER PUBLICATIONS

Sen et al., Developments in directed evolution for improving enzyme functions. Appl. Biochem. Biotechnol., 2007, vol. 143: 212-223.*
Whisstock et al., Prediction of protein function from protein sequence. Q. Rev. Biophysics., 2003, vol. 36 (3): 307-340.*
Wishart et al., A single mutation converts a novel phosphotyrosine binding domain into a dual-specificity phosphatase. J. Biol. Chem., 1995, vol. 270(45): 26782-26785.*
Witkowski et al., Conversion of b-ketoacyl synthase to a Malonyl Decarboxylase by replacement of the active cysteine with glutamine. Biochemistry, 1999, vol. 38: 11643-11650.*
Ostergaard, et al. Metabolic engineering of *Saccharomyces cerevisiae*. Microbiol Mol Biol Rev. Mar. 2000;64(1):34-50. Review.
Akbergenov; et al., "ARC-1, a sequence element complementary to an internal 18S rRNA segment, enhances translation efficiency in plants when present in the leader or intercistronic region of mRNAs. Nucleic Acids Res. Jan. 12, 2004;32(1):239-47. Print 2004.".
Alani; et al., "A method for gene disruption that allows repeated use of URA3 selection in the construction of multiply disrupted yeast strains. Genetics. Aug. 1987;116(4):541-5.".
Amberg; et al., "Methods in yeast genetics. A Cold Spring Harbor Laboratory Course Manual. New York: Cold Spring Harbor Laboratory (2005).".
Arie; et al., "Phylogenetic identification of n-alkane assimilating Candida yeasts based on nucleotide divergence in the 59 end of LSU rDNA gene. J Gen Appl Microbiol. Oct. 2000;46(5):257-262.".
Ausubel; et al., "Current Protocols in Molecular Biology. John Wiley & Sons, N. Y., 6.3.1-6.3.6 (1989).".
Brock; T., "Biotechnology: A Textbook of Industrial Microbiology, 1989.".
Butler; et al., "Evolution of pathogenicity and sexual reproduction in eight Candida genomes. Nature, vol. 459, No. 7247, Jun. 4, 2009, pp. 657-662.".
Chen; et al., "Biosynthesis of phytosterol esters: identification of a sterol o-acyltransferase in *Arabidopsis*. Plant Physiol. Nov. 2007;145(3):974-84. Epub Sep. 20, 2007.".
Craft; et al., "Identification and characterization of the CYP52 family of *Candida tropicalis* ATCC 20336, important for the conversion of fatty acids and alkanes to alpha,omega-dicarboxylic acids. Appl Environ Microbiol. Oct. 2003;69(10):5983-91.".
Dahlqvist; et al., "Phospholipid:diacylglycerol acyltransferase: an enzyme that catalyzes the acyl-CoA-independent formation of triacylglycerol in yeast and plants. Proc Natl Acad Sci U S A. Jun. 6, 2000;97(12):6487-92.".

"Database UniParc (Online) XP002723041, accession No. uniparc:upi000192e0db Database accession No. UP1000192E0DB, the whole document".
"Database UniParc (Online) XP002723065, accession No. uniparc:upi000183D606 Database accession No. UPI000183d606, the whole document".
Demant; et al., "Continuous recording of long-chain acyl-coenzyme a synthetase activity using fluorescently labeled bovine serum albumin. Anal Biochem. Aug. 1, 2001;295(1):38-44.".
Deshpande; M., "Ethanol production from cellulose by coupled saccharification/fermentation using *Saccharomyces cerevisiae* and cellulase complex from Sclerotium rolfsii UV-8 mutant. Appl Biochem Biotechnol. Sep. 1992;36(3):227-34.".
Eggertsson; et al., "Transfer ribonucleic acid-mediated suppression of termination codons in *Escherichia coli*. Microbiol Rev. Sep. 1988;52(3):354-74.".
Engleerg-Kukla et al., "(1996) in *Escherichia coli* and *Salmonella* Cellular and Molecular Biology, Chapter 60, pp. 909-921.".
Gallie Dr., "The 5'-leader of tobacco mosaic virus promotes translation through enhanced recruitment of eIF4F. Nucleic Acids Res. Aug. 1, 2002;30(15):3401-11.".
Gallie; et al., "The 5'-leader sequence of tobacco mosaic virus RNA enhances the expression of foreign gene transcripts in vitro and in vivo. Nucleic Acids Res. Apr. 24, 1987;15(8):3257-73.".
Geelen; Mj., "Measurement of diacylglycerol acyltransferase activity in isolated hepatocytes. Anal Biochem. Nov. 15, 2003;322(2):264-8.".
"International Preliminary Report on Patentability dated Jun. 23, 2015 for PCT Application No. US2013/076664.".
"International search report and written opinion dated Oct. 31, 2014 for PCT Application No. US2013/076664.".
Jin; et al., "Optimal growth and ethanol production from xylose by recombinant *Saccharomyces cerevisiae* require moderate D-xylulokinase activity. Appl Environ Microbiol. Jan. 2003;69(1):495-503.".
Kawachi; et al., "Gene Analysis of an NADP-Linked Isocitrate Dehydrogenase Localized in Peroxisomes of the n-Alkane-Assimilating Yeast Candida tropicalis. European Journal of Biochemistry, vol. 250, No. 1, Nov. 15, 1997, pp. 205-211.".
Lageweg; et al., "A fluorimetric assay for acyl-CoA synthetase activities. Anal Biochem. Sep. 2, 1991;197(2):384-8.".
Landy; A., "Mechanistic and structural complexity in the site-specific recombination pathways of Int and FLP. Curr Opin Genet Dev. Oct. 1993;3(5):699-707.".
Masters; et al., "The preparation and properties of microsomal TPNH-cytochrome c reductase from pig liver. Methods in enzymology 10 (1967): 565-573.".
Meyers; et al., "Optimal alignments in linear space. Computer applications in the biosciences: Cabios 4.1 (1988): 11-17.".
Mignone; et al., "Untranslated regions of mRNAs. Genome Biol. 2002;3(3):REVIEWS0004. Epub Feb. 28, 2002.".
Mignone; et al., "UTRdb and UTRsite: a collection of sequences and regulatory motifs of the untranslated regions of eukaryotic mRNAs. Nucleic Acids Res. Jan. 1, 2005;33(Database issue):D141-6.".
Needleman; et al., "A general method applicable to the search for similarities in the amino acid sequence of two proteins. Journal of molecular biology 48.3 (1970): 443-453.".
Neidhardt; et al., "*Escherichia coli* and *Salmonella typhimurium*: Cellular and Molecular Biology, American Society for Microbiology, Washington, DC (1987).".
Nelson; et al., "Simultaneous detection of multiple nucleic acid targets in a homogeneous format. Biochemistry. Jun. 25, 1996;35(25):8429-38.".
Papanikolaou; et al., "Lipid production by Yarrowia lipolytica growing on industrial glycerol in a single-stage continuous culture. Bioresour Technol. Mar. 2002;82(1):43-9.".
Paulous; et al., "Comparison of the capacity of different viral internal ribosome entry segments to direct translation initiation in poly(A)-dependent reticulocyte lysates. Nucleic Acids Res. Jan. 15, 2003;31(2):722-33.".

(56) References Cited

OTHER PUBLICATIONS

"QMED Qualified Suppliers to the Medical Device Industry website. Accessed Aug. 28, 2015. http://www.qmed.com/supplier-directory.".

Saerens; et al., "Cloning and functional characterization of the UDP-glucosyltransferase UgtB1 involved in sophorolipid production by Candida bombicola and creation of a glucolipid-producing yeast strain. Yeast. Apr. 2011;28(4):279-92. doi: 10.1002/yea.1838. Epub Jan. 16, 2011.".

Saerens; et al., "Identification of the UDP-glucosyltransferase gene UGTA1, responsible for the first glucosylation step in the sophorolipid biosynthetic pathway of Candida bombicola ATCC 22214. FEMS Yeast Res. Feb. 2011;11(1):123-32. doi: 10.1111/j.1567-1364.2010.00695.x. Epub Nov. 12, 2010.".

Sambrook; et al., "Molecular Cloning: A Laboratory Manual, Cold Spring Harbor Laboratory, N. Y., 1982.".

Sauer; B., "Site-specific recombination: developments and applications. Curr Opin Biotechnol. Oct. 1994;5(5):521-7.".

Sekiguchi; et al., "Requirements for noncovalent binding of vaccinia topoisomerase I to duplex DNA. Nucleic Acids Res. Dec. 11, 1994;22(24):5360-5.".

Shaloiko; et al., "Effective non-viral leader for cap-independent translation in a eukaryotic cell-free system. Biotechnology and bioengineering 88.6 (2004): 730-739.".

Shuman; S., "Site-specific interaction of vaccinia virus topoisomerase I with duplex DNA. Minimal DNA substrate for strand cleavage in vitro. J Biol Chem. Jun. 15, 1991;266(17):11372-9.".

"Tag-On-Demand Gateway Vector Instruction Manual. Version B, Jun. 20, 2003. http://tools.thermofisher.com/content/sfs/manuals/tagondemand_vectors_man.pdf.".

"Tag-On-Demand Suppressor Supernatant Instruction Manual, Version B, Jun. 6, 2003. www.invitrogen.comicontent/sfs/manuals/tagondemand_supernatant_man.pdf.".

Tjalsma; et al., "Signal peptide-dependent protein transport in Bacillus subtilis: a genome-based survey of the secretome. Microbiol Mol Biol Rev. Sep. 2000;64(3):515-47.".

Vincent; et al., "Helicase-dependent isothermal DNA amplification. EMBO Rep. Aug. 2004;5(8):795-800. Epub Jul. 9, 2004.".

Yamada; et al., "Assay of fatty acid omega-hydroxylation using high-performance liquid chromatography with fluorescence labeling reagent, 3-bromomethyl-7-methoxy-1,4-benzoxazin-2-one (BrMB). Anal Biochem. Nov. 15, 1991;199(1):132-6.".

Cao, et al. Engineering the acetyl-CoA transportation system of candida tropicalis enhances the production of dicarboxylic acid. Biotechnol J. Jan. 2006;1(1):68-74.

Dommes, et al. Oxidation in Candida tropicalis: Partial purification and biological function of an inducible 2,4-Dienoyl Coenzyme a Reductase. The Journal of Biological Chemistry. Sep. 25, 1983. pages 10846-10852.

Klein, et al. Alleviation of glucose repression of maltose metabolism by MIG1 disruption in *Saccharomyces cerevisiae*. Appl Environ Microbiol. Dec. 1996;62(12):4441-9.

Rolland, et al. Glucose-sensing and -signalling mechanisms in yeast. FEMS Yeast Res. May 2002;2(2):183-201.

Theodoulou, et al. Peroxisomal ABC transporters. FEBS Lett. Feb. 13, 2006;580(4):1139-55. Epub Jan. 9, 2006.

\* cited by examiner

BIOLOGICAL METHODS FOR PREPARING A FATTY DICARBOXYLIC ACID

CROSS REFERENCE TO RELATED APPLICATIONS

This application is a U.S. National Stage Entry of PCT/US2013/076664, filed Dec. 19, 2013, which claims the benefit under 35 U.S.C. § 119(e) of U.S. Provisional Patent Application No. 61/739,656, filed Dec. 19, 2012; all of which are herein incorporated by reference in their entireties.

SEQUENCE LISTING

The instant application contains a Sequence Listing which has been submitted electronically in ASCII format and is hereby incorporated by reference in its entirety. Said ASCII copy, created on Jun. 24, 2016, is named 32188-707_831_SL.txt and is 784,650 bytes in size.

FIELD

The technology relates in part to biological methods for producing a fatty dicarboxylic acid and engineered microorganisms capable of such production.

BACKGROUND

Microorganisms employ various enzyme-driven biological pathways to support their own metabolism and growth. A cell synthesizes native proteins, including enzymes, in vivo from deoxyribonucleic acid (DNA). DNA first is transcribed into a complementary ribonucleic acid (RNA) that comprises a ribonucleotide sequence encoding the protein. RNA then directs translation of the encoded protein by interaction with various cellular components, such as ribosomes. The resulting enzymes participate as biological catalysts in pathways involved in production of molecules by the organism.

These pathways can be exploited for the harvesting of the naturally produced products. The pathways also can be altered to increase production or to produce different products that may be commercially valuable. Advances in recombinant molecular biology methodology allow researchers to isolate DNA from one organism and insert it into another organism, thus altering the cellular synthesis of enzymes or other proteins. Advances in recombinant molecular biology methodology also allow endogenous genes, carried in the genomic DNA of a microorganism, to be increased in copy number, thus altering the cellular synthesis of enzymes or other proteins. Such genetic engineering can change the biological pathways within the host organism, causing it to produce a desired product. Micro-organic industrial production can minimize the use of caustic chemicals and the production of toxic byproducts, thus providing a "clean" source for certain compounds. The use of appropriate plant derived feedstocks allows production of "green" compounds while further minimizing the need for and use of petroleum derived compounds.

SUMMARY

Provided in certain aspects is a genetically modified yeast, comprising: one or more genetic modifications that substantially block beta oxidation activity; and one or more genetic modifications that increase one or more activities chosen from monooxygenase activity, monooxygenase reductase activity, thioesterase activity, acyltransferase activity, isocitrate dehydrogenase activity, glyceraldehyde-3-phosphate dehydrogenase activity, glucose-6-phosphate dehydrogenase activity, acyl-coA oxidase activity, fatty alcohol oxidase activity, acyl-CoA hydrolase activity, alcohol dehydrogenase activity, peroxisomal biogenesis factor activity, and fatty aldehyde dehydrogenase activity.

The one or more genetic modifications sometimes increase one or more of: (a) one or more monooxygase activities chosen from monooxygenase activity chosen from CYP52A12 monooxygenase activity, CYP52A13 monooxygenase activity, CYP52A14 monooxygenase activity, CYP52A15 monooxygenase activity, CYP52A16 monooxygenase activity, CYP52A17 monooxygenase activity, CYP52A18 monooxygenase activity, CYP52A19 monooxygenase activity, CYP52A20 monooxygenase activity, CYP52D2 monooxygenase activity and BM3 monooxygenase activity; (b) one or more monooxygenase reductase activities chosen from CPRA monooxygenase reductase activity, CPRB monooxygenase reductase activity and CPR750 monooxygenase reductase activity; (c) an IDP2 isocitrate dehydrogenase activity; (d) a GDP1 glyceraldehyde-3-phosphate dehydrogenase activity; (e) one or more glucose-6-phosphate dehydrogenase activities chosen from a ZWF1 glucose-6-phosphate dehydrogenase activity and ZWF2 glucose-6-phosphate dehydrogenase activity; (f) one or more fatty alcohol oxidase activities chosen from FAO1 fatty alcohol oxidase activity, FAO2A fatty alcohol oxidase activity, FAO2B fatty alcohol oxidase activity, FAO13 fatty alcohol oxidase activity, FAO17 fatty alcohol oxidase activity, FAO18 fatty alcohol oxidase activity and FAO20 fatty alcohol oxidase activity; (g) one or more alcohol dehydrogenase activities chosen from ADH1 alcohol dehydrogenase activity, ADH2 alcohol dehydrogenase activity, ADH3 alcohol dehydrogenase activity, ADH4 alcohol dehydrogenase activity, ADH5 alcohol dehydrogenase activity, ADH7 alcohol dehydrogenase activity, ADH8 alcohol dehydrogenase activity and SFA alcohol dehydrogenase activity; (h) one or more acyl-CoA hydrolase activities chosen from ACH-A acyl-CoA hydrolase activity and ACH-B acyl-CoA hydrolase activity; (i) one or more acyltransferase activities chosen from acyl-CoA sterol acyltransferase activity, diacylglycerol acyltransferase activity and phospholipid:diacylglycerol acyltransferase activity; (j) one or more acyltransferase activities chosen from ARE1 acyl-CoA sterol acyltransferase activity, ARE2 acyl-CoA sterol acyltransferase activity, DGA1 diacylglycerol acyltransferase activity, and LRO1 phospholipid:diacylglycerol acyltransferase activity; (k) an acyl-coA thioesterase activity (e.g., a TESA acyl-coA thioesterase activity); (l) a PEX11 peroxisomal biogenesis factor activity; (m) one or more fatty aldehyde dehydrogenase activities chosen from HFD1 fatty aldehyde dehydrogenase activity and HFD2 fatty aldehyde dehydrogenase activity; and (n) a POX5 acyl-coA oxidase activity.

In certain aspects, a genetically modified yeast is fully beta oxidation blocked. In some cases all alleles of polynucleotides encoding a polypeptide having acyl-coA oxidase activity are disrupted in a genetically modified yeast. In certain cases where a genetically modified yeast is a *Candida* spp. yeast, all alleles of POX4 and POX5 are disrupted.

In some aspects, a genetic modification that increases an activity in a genetically modified yeast comprises incorporating in the yeast multiple copies of a polynucleotide that encodes a polypeptide having the activity. Sometimes a genetic modification that increases an activity in a genetically modified yeast comprises incorporating in the yeast a promoter in operable linkage with a polynucleotide that encodes a polypeptide having the activity. In some cases the promoter is chosen from a POX4 promoter, PEX11 promoter, TEF1 promoter, PGK promoter and FAO1 promoter.

In certain aspects, a genetically modified yeast comprises one or more genetic modifications that decrease an acyl-coA synthetase activity. In some cases the one or more genetic modifications decrease one or more acyl-coA synthetase activities chosen from an ACS1 acyl-coA synthetase activity and a FAT1 long-chain acyl-CoA synthetase activity.

In some aspects, a genetically modified yeast is chosen from a *Candida* spp. yeast (e.g., *C. tropicalis*, *C. viswanathii*, genetically modified ATCC20336 yeast), *Yarrowia* spp. yeast, *Pichia* spp. yeast, *Saccharomyces* spp. yeast and *Kluyveromyces* spp. yeast.

Any suitable combination of genetic modifications described herein can be incorporated into a genetically modified yeast for production of a diacid target product. In some cases, a genetically modified yeast includes one or more of (a) a genetic modification that increases an activity, (b) a genetic modification that decreases an activity, and (c) a promoter insertion, as described herein, in any suitable combination.

In some aspects, provided is a method for producing a diacid, comprising: contacting a genetically modified yeast described herein with a feedstock capable of being converted by the yeast to a diacid; and culturing the yeast under conditions in which the diacid is produced from the feedstock. In some cases the feedstock comprises one or more components from a vegetable oil, and sometimes the diacid is a C4 to C24 diacid.

In certain aspects, provided is a method for producing a diacid by a yeast from a feedstock toxic to the yeast, comprising: (a) contacting a genetically modified yeast in culture with a feedstock not substantially toxic to the yeast, thereby performing an induction; and (b) contacting the yeast after the induction in (a) with a feedstock toxic to the yeast, whereby a diacid is produced by the yeast from the feedstock toxic to the yeast in an amount greater than the amount of the diacid produced from the feedstock toxic to the yeast when the induction is not performed.

Provided also herein in some aspects are particular isolated nucleic acids.

Certain embodiments are described further in the following description, examples, claims and drawings.

BRIEF DESCRIPTION OF THE DRAWINGS

The drawings illustrate embodiments of the technology and are not limiting. For clarity and ease of illustration, the drawings are not made to scale and, in some instances, various aspects may be shown exaggerated or enlarged to facilitate an understanding of particular embodiments.

FIG. 12 graphically illustrates the conversion of decane to sebacic acid in a_fully beta-oxidation blocked *C. tropicalis* yeast strain having additional genetic modifications. Strain sAA003 is the fully beta-oxidation blocked control strain. +CPR indicates the fully beta-oxidation blocked strain also includes an increased number of copies of cytochrome P450 reductase. +CPR+A12 indicates starting strain sAA003 includes the addition genetic modifications of an increased number of copies of cytochrome P450 reductase and also includes an increased number of copies of cytochrome P450 A12 (e.g., CYP52A12). +CPR+A18 indicates starting strain sAA003 includes the addition genetic modifications of an increased number of copies of cytochrome P450 reductase and also includes an increased number of copies of cytochrome P450 A18 (e.g., CYP52A18). +CPR+A19 indicates starting strain sAA003 includes the addition genetic modifications of an increased number of copies of cytochrome P450 reductase and also includes an increased number of copies of cytochrome P450 A19 (e.g., CYP52A19). +CPR+A20 indicates starting strain sAA003 includes the addition genetic modifications of an increased number of copies of cytochrome P450 reductase and also includes an increased number of copies of cytochrome P450 A20 (e.g., CYP52A20). Experimental details and results are given in Example 7.

Figure 13:
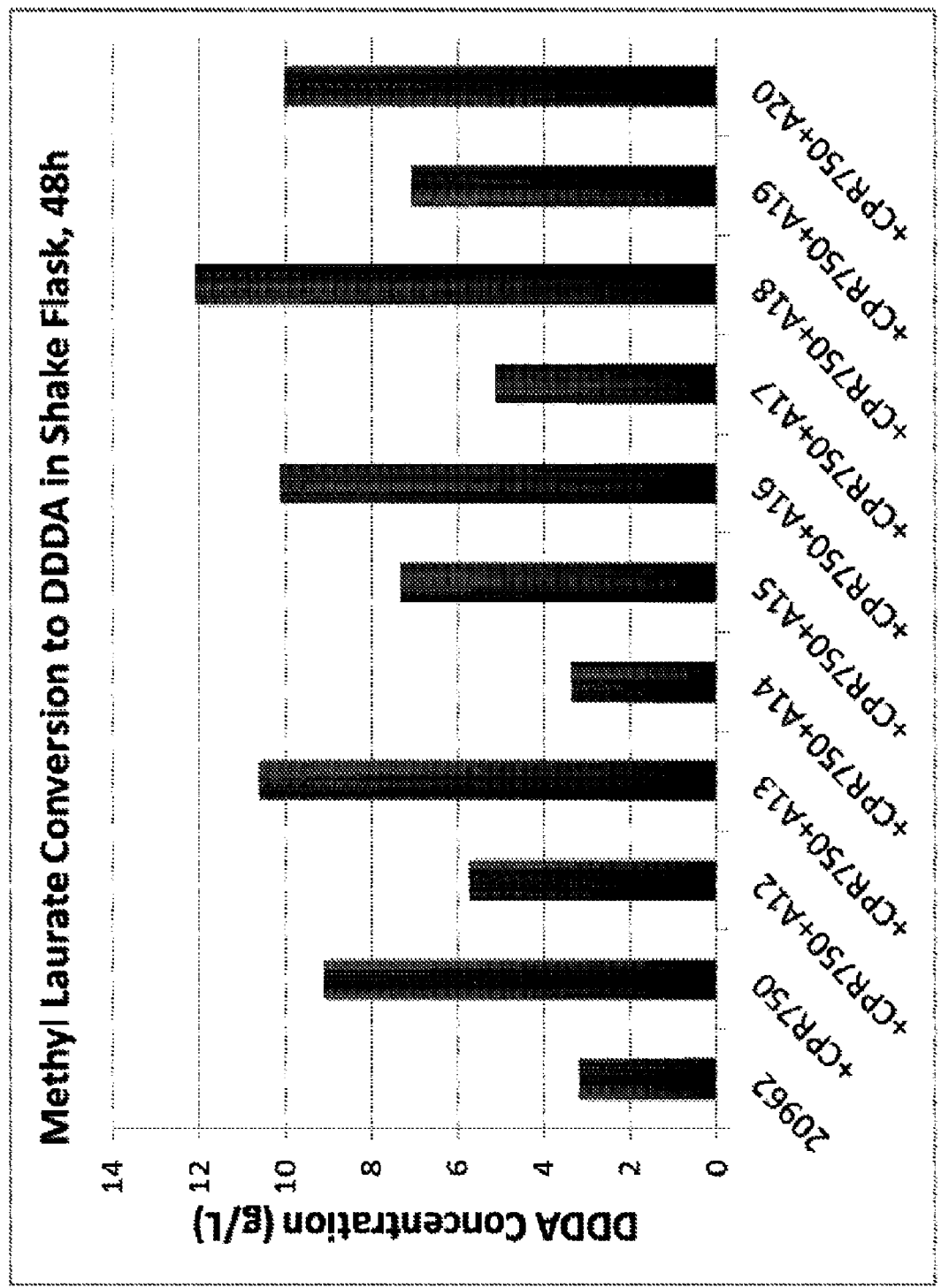

FIG. 13 graphically illustrates the results of conversion of methyl laurate to dodecanedioic acid in a fully beta-oxidation blocked *C. tropicalis* yeast strain also contain genetic alterations to a monooxygenase reductase activity, a monooxygenase activity, or a monooxygenase reductase activity and a monooxygenase activity. After 48 hours of incubation the media was subjected to gas chromatography. The results indicate that *Candida* strains containing an increased number of copies of a CYP52A18 monooxygenase activity and an increased number of copies of a monooxygenase reductase activity (e.g., CPR750) gave the highest yield of dodecanedioic acid (e.g., DDDA), in shake flask fermentation experiments. Experimental details and results are given in Example 8.

Figure 14:
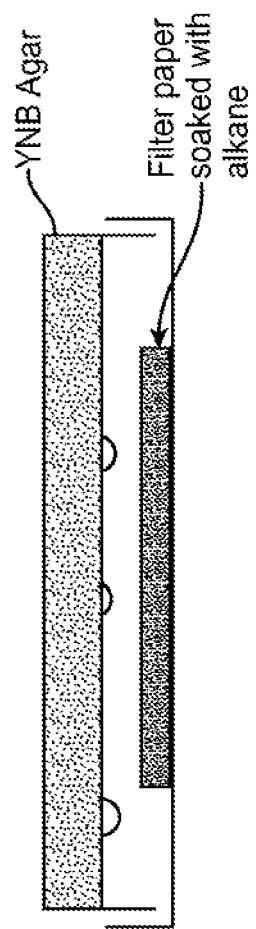
Figure 15:
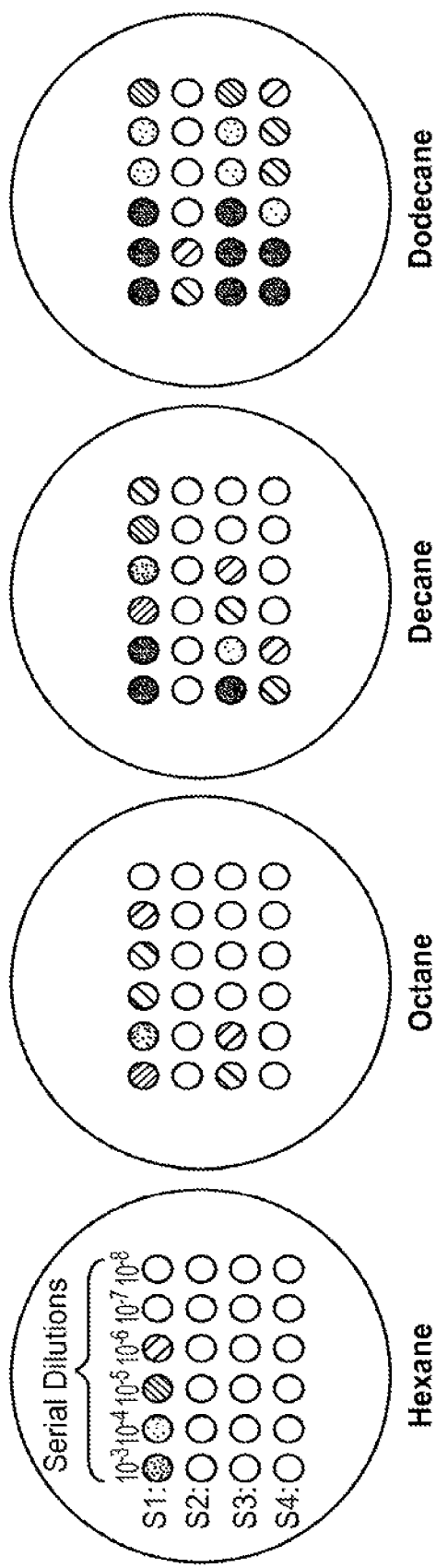

FIG. 14 and FIG. 15 schematically illustrate a screening and/or selection method for identifying acyl-CoA oxidase activities with specific substrate specificities. The method can be utilized in conjunction with generating and/or identifying acyl-CoA oxidase activities with altered chain-length substrate specificities. Screening/selection method details are given in Example 9.

Figure 16:
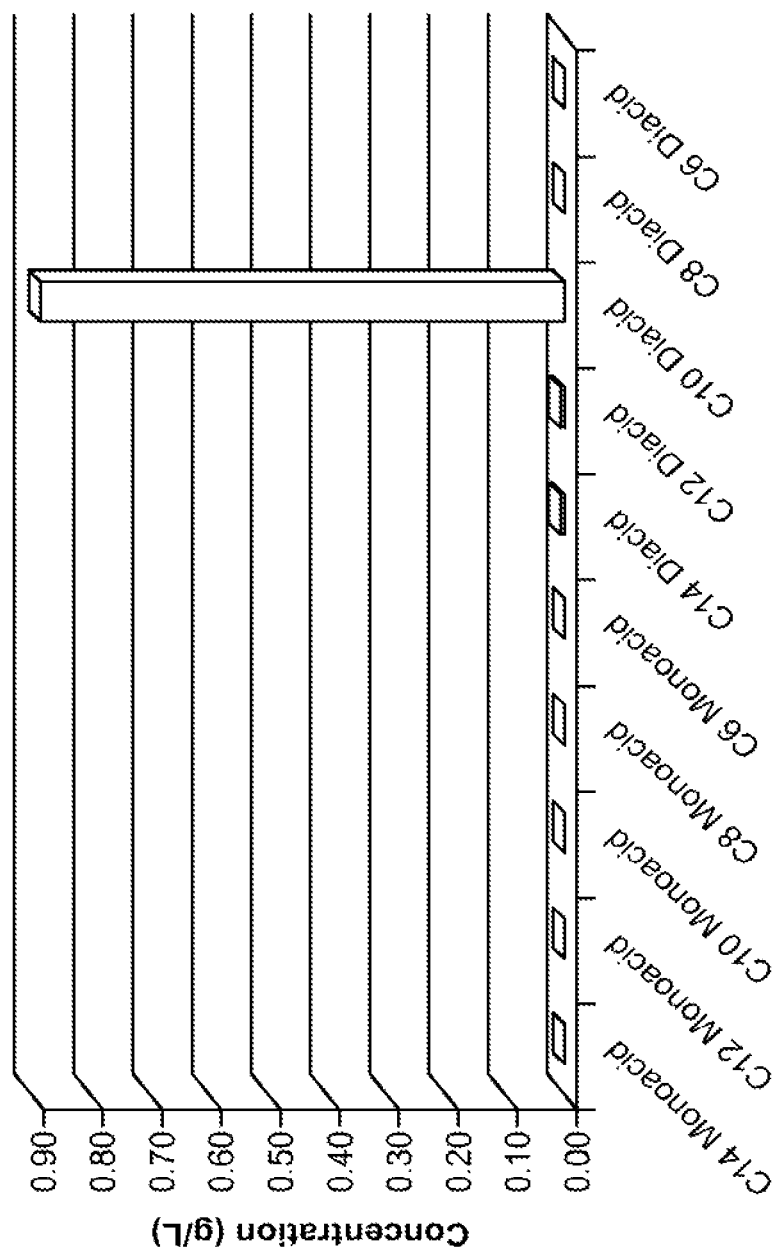

FIG. 16 graphically illustrates the results of engineered microorganisms described herein converting decane to sebacic acid under fermentation conditions using different amounts of decane as the feedstock. Experimental details and results are given in Example 3.

Figure 17:
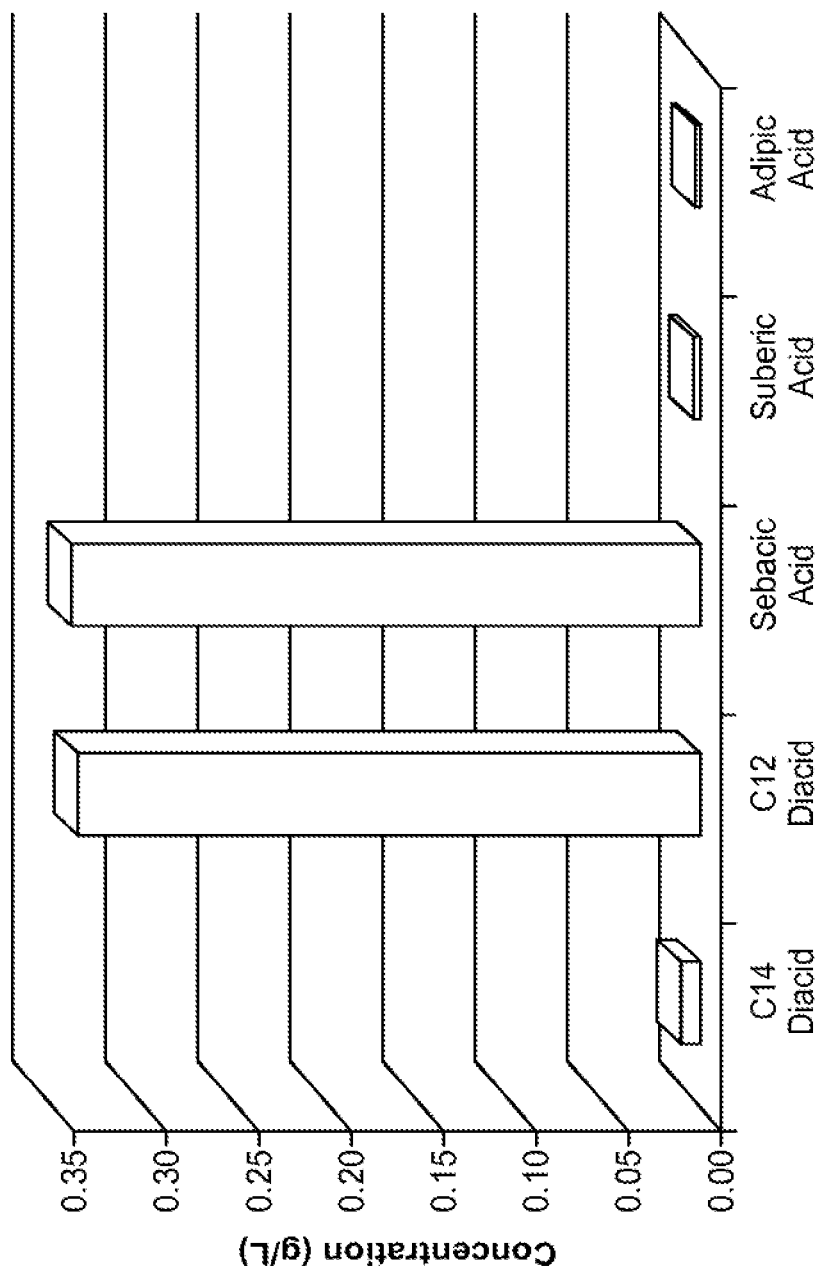

FIG. 17 graphically illustrates the results of engineered microorganisms described herein converting a mixed fatty acid feedstock (e.g., mixed chain-length fatty acids) to sebacic acid under fermentation conditions. Experimental details and results are given in Example 4.

Figure 18:
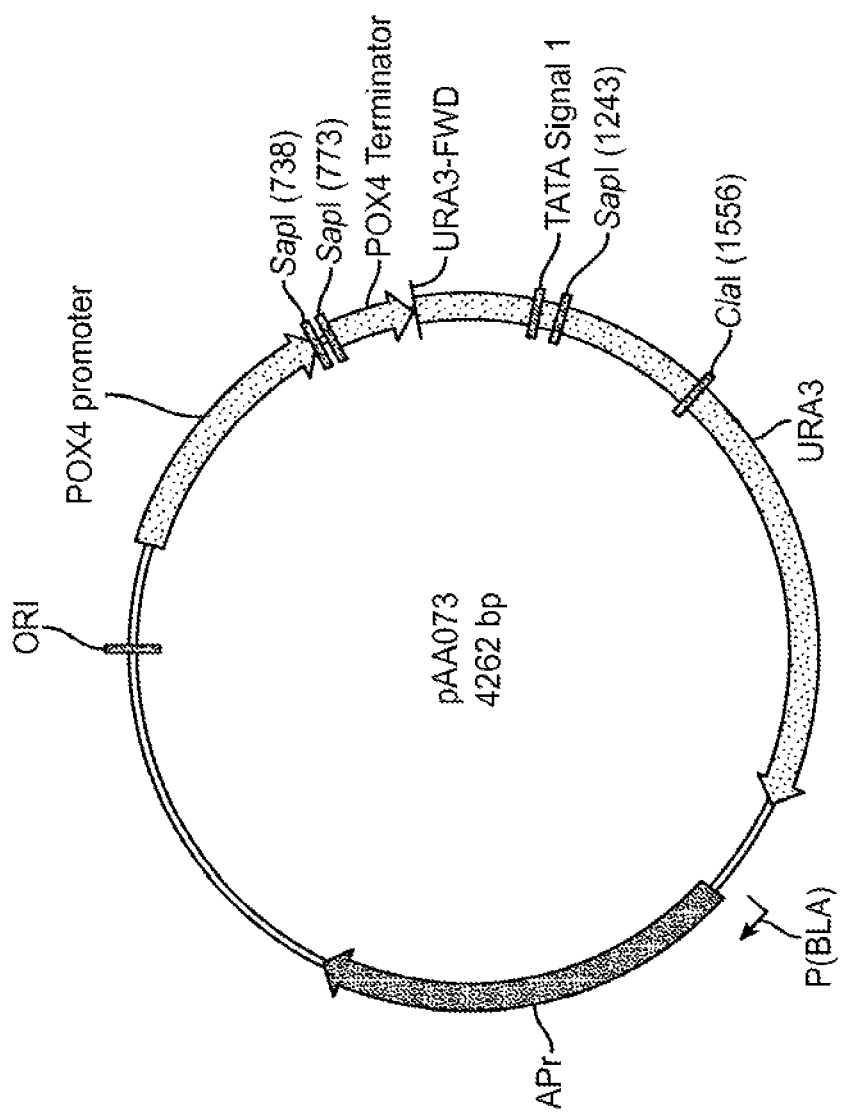

FIG. 18 shows a diagram of a plasmid designated pAA073 containing a POX4 promoter and a POX4 terminator.

Figure 19:
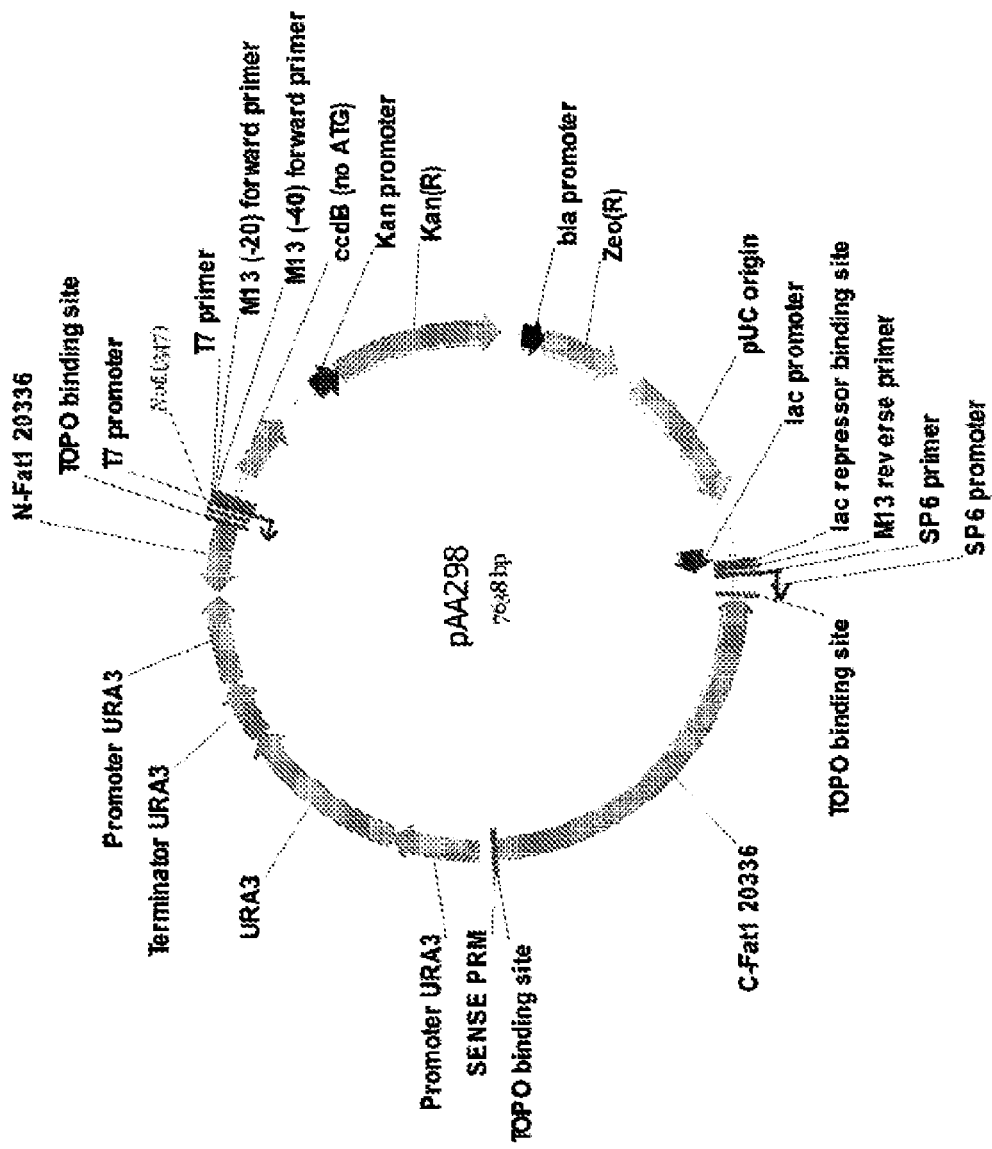

FIG. 19 shows a diagram of a plasmid designated pAA298.

Figure 20:
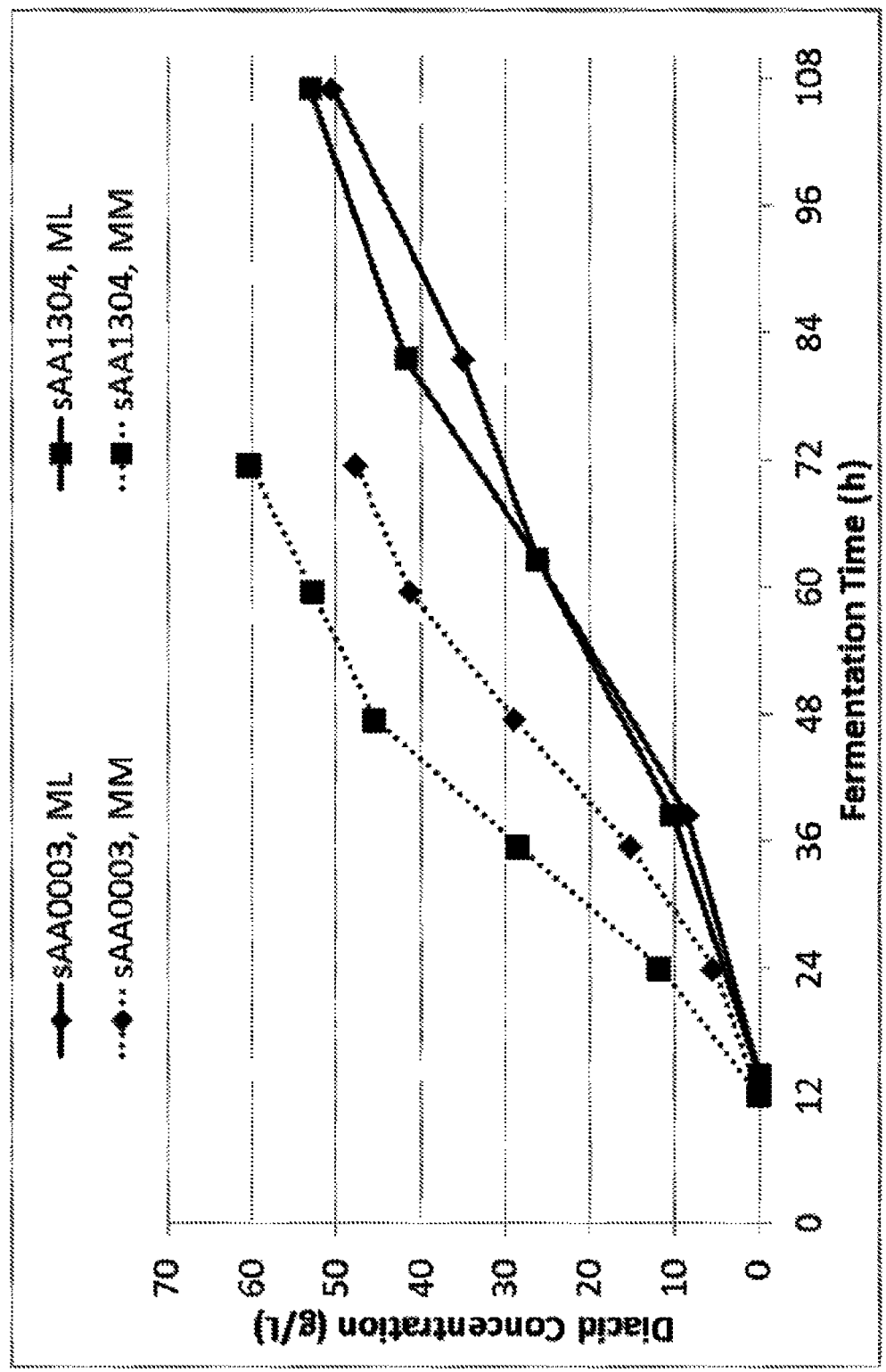

FIG. 20 shows the production of either dodecanedioic acid from methyl laurate (ML) or tetradecanedioic acid from methyl myristate (MM) utilizing strains sAA1306 and sAA003.

Figure 21:
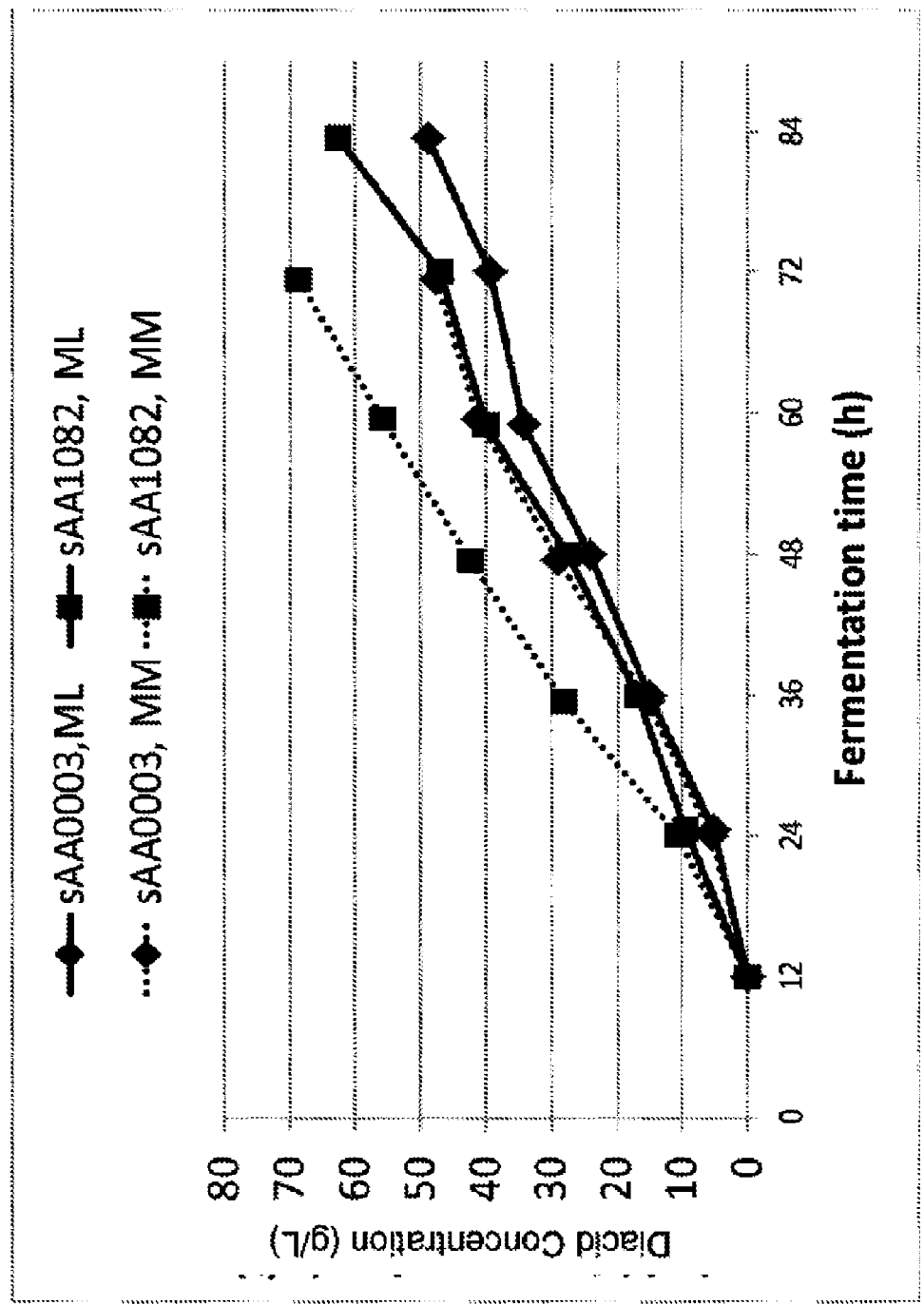

FIG. 21 shows the production of either dodecanedioic acid from methyl laurate (ML) or tetradecanedioic acid from methyl myristate (MM) using strains sAA1082 and sAA003.

Figure 22:
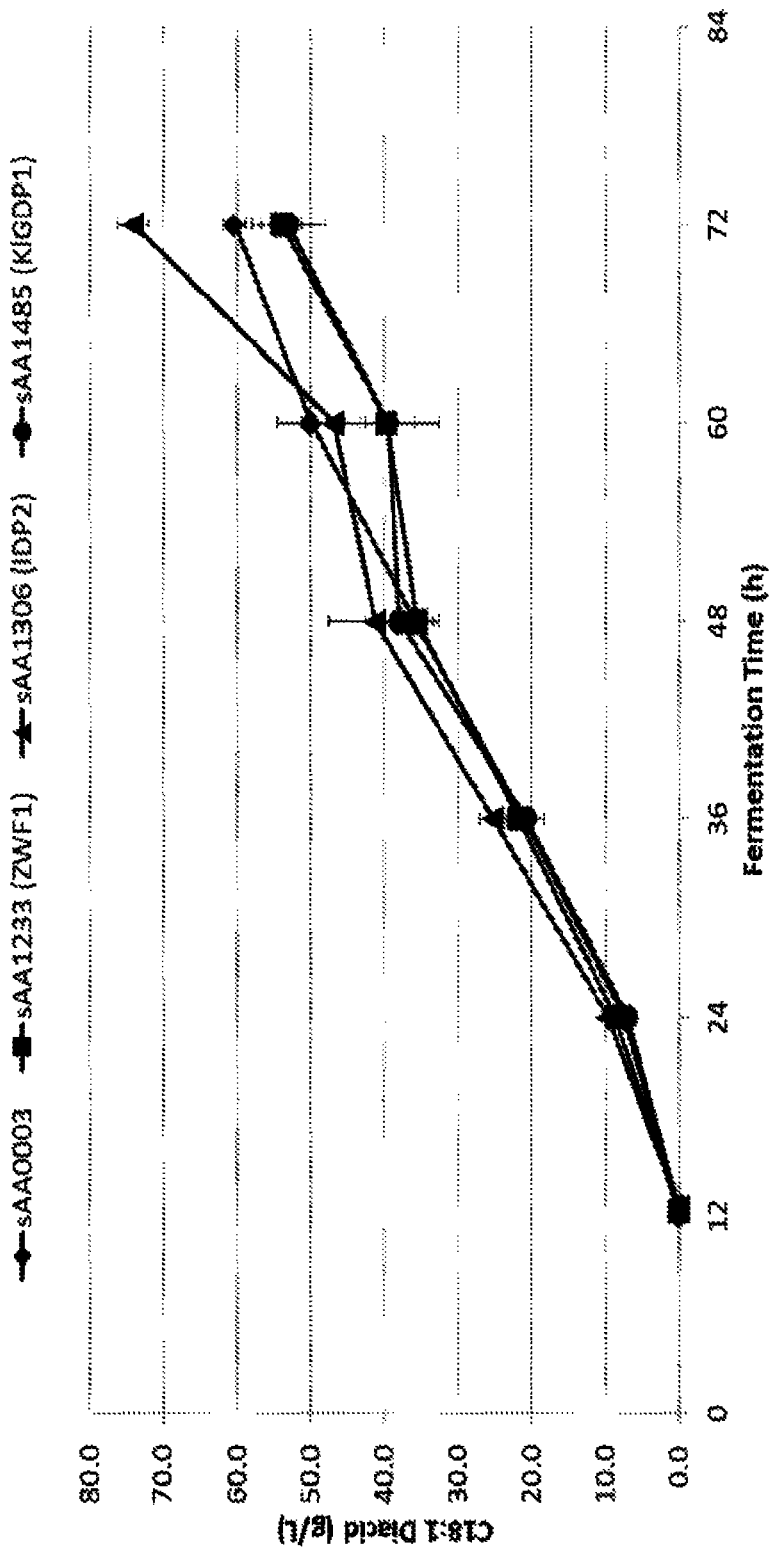

FIG. 22 shows the production cis-9-octadecenedioic acid (C18:1 diacid) from oleic acid for four fully beta-oxidation blocked strains. The data points are derived from the averages of three identical fermentations.

Figure 23:
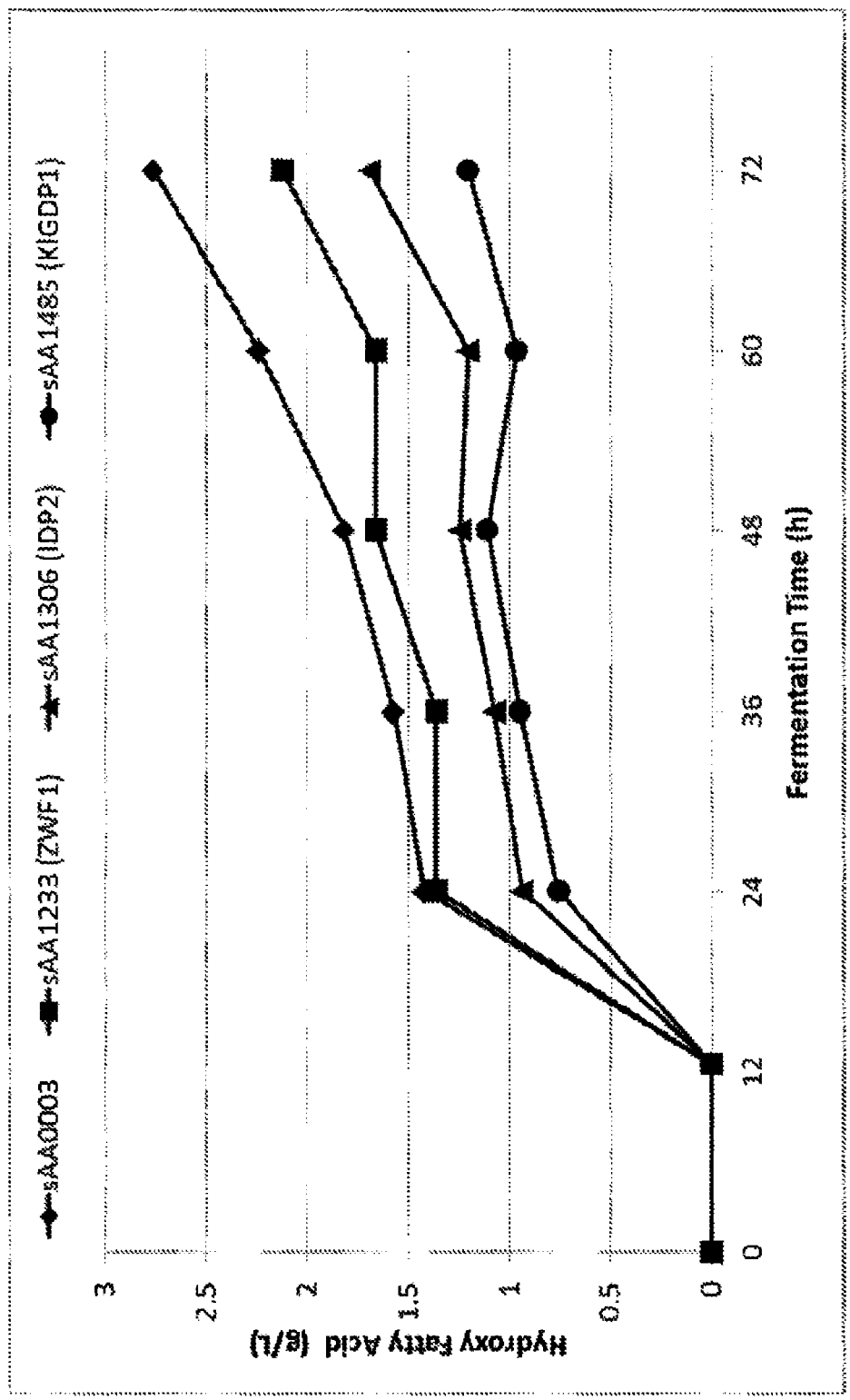

FIG. 23 shows the concentrations of HFAs produced during the omega oxidation of oleic acid by strains sAA003, sAA1233, sAA1306 and sAA1485.

Figure 24:
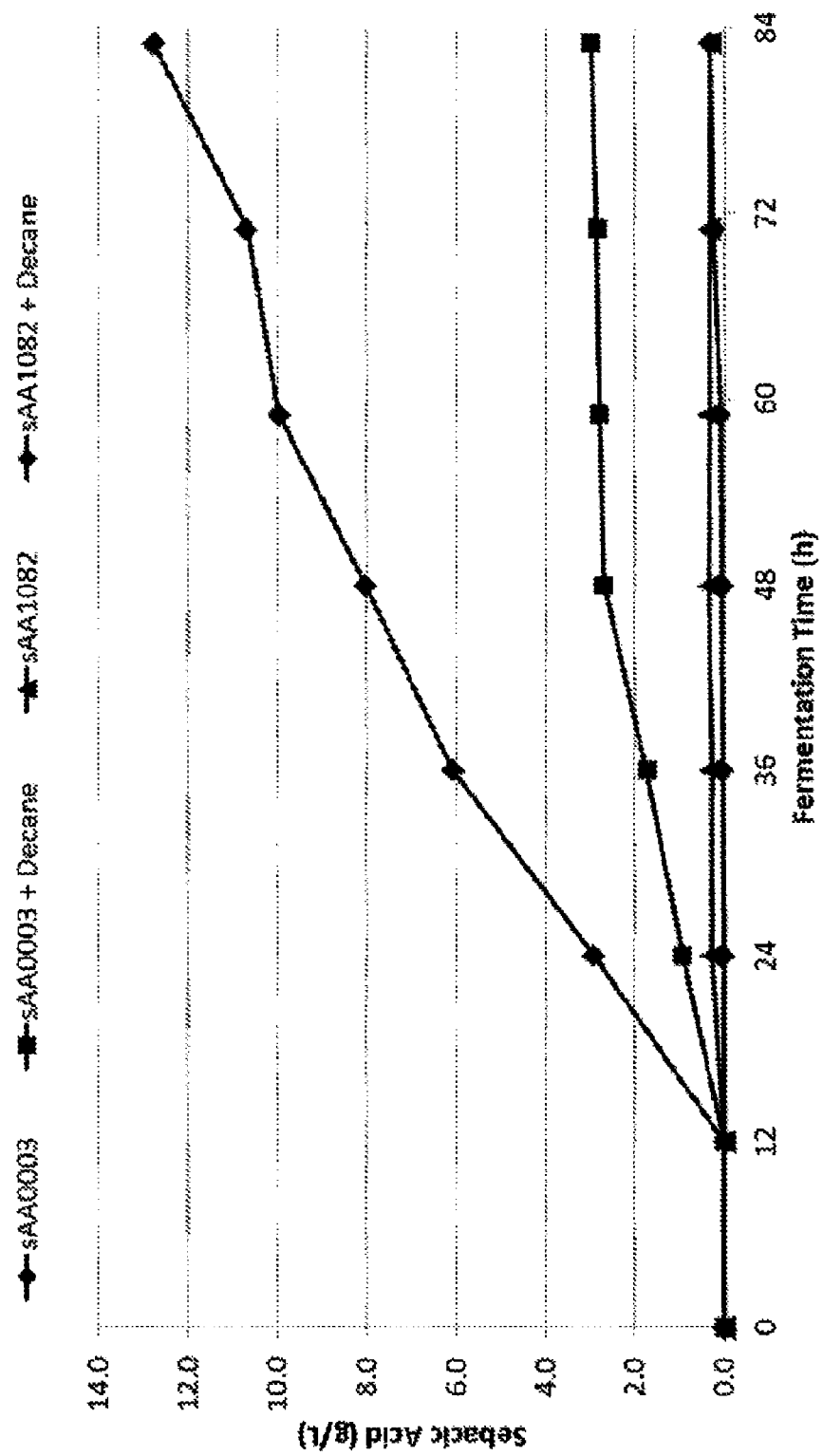

FIG. 24 shows the production of decanedioic acid (sebacic acid) and compares the productivity of the two strains under the two different induction conditions.

Figure 25:
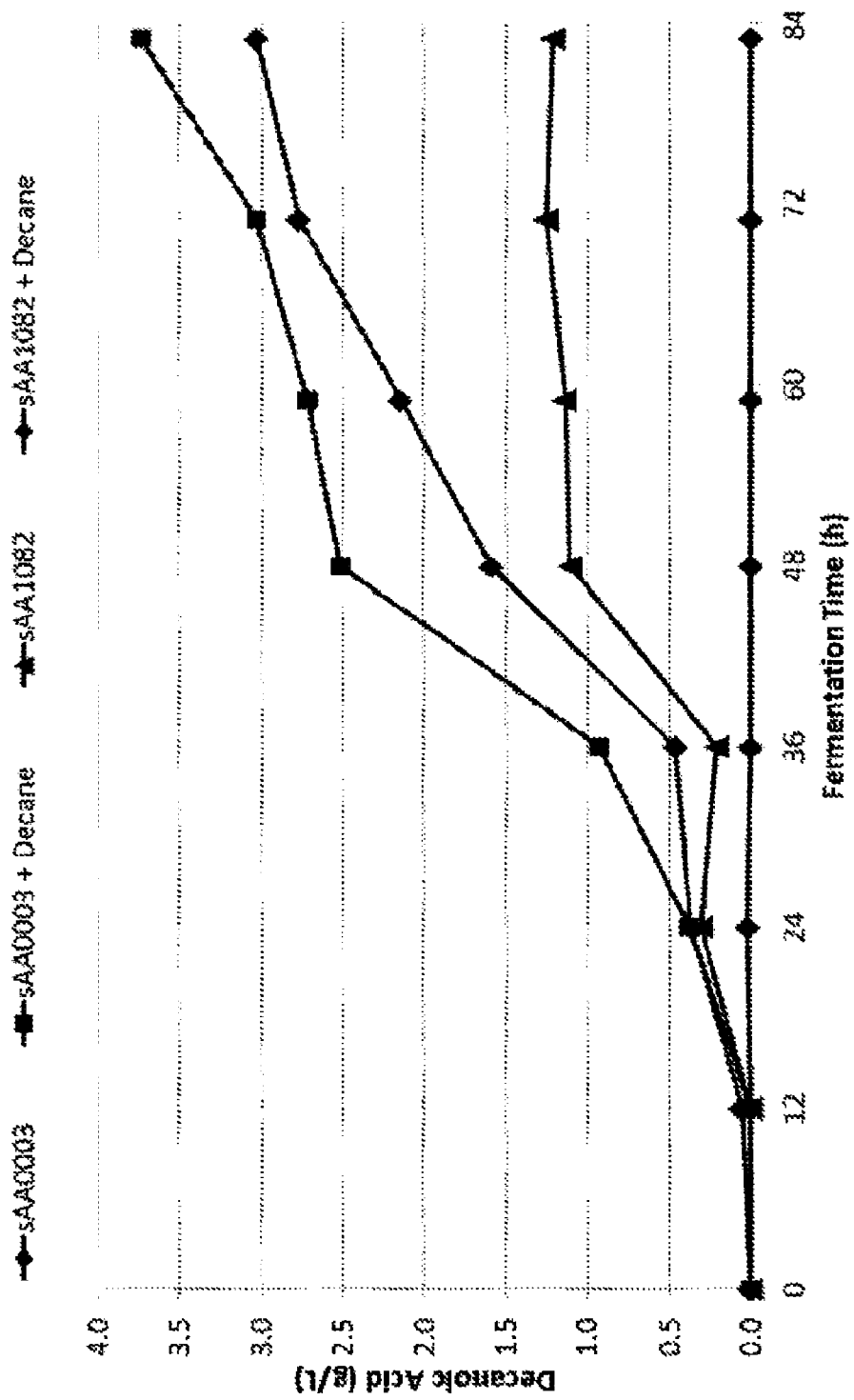

FIG. 25 shows the amount of decanoic acid produced under the different fermentation conditions.

Figure 26:
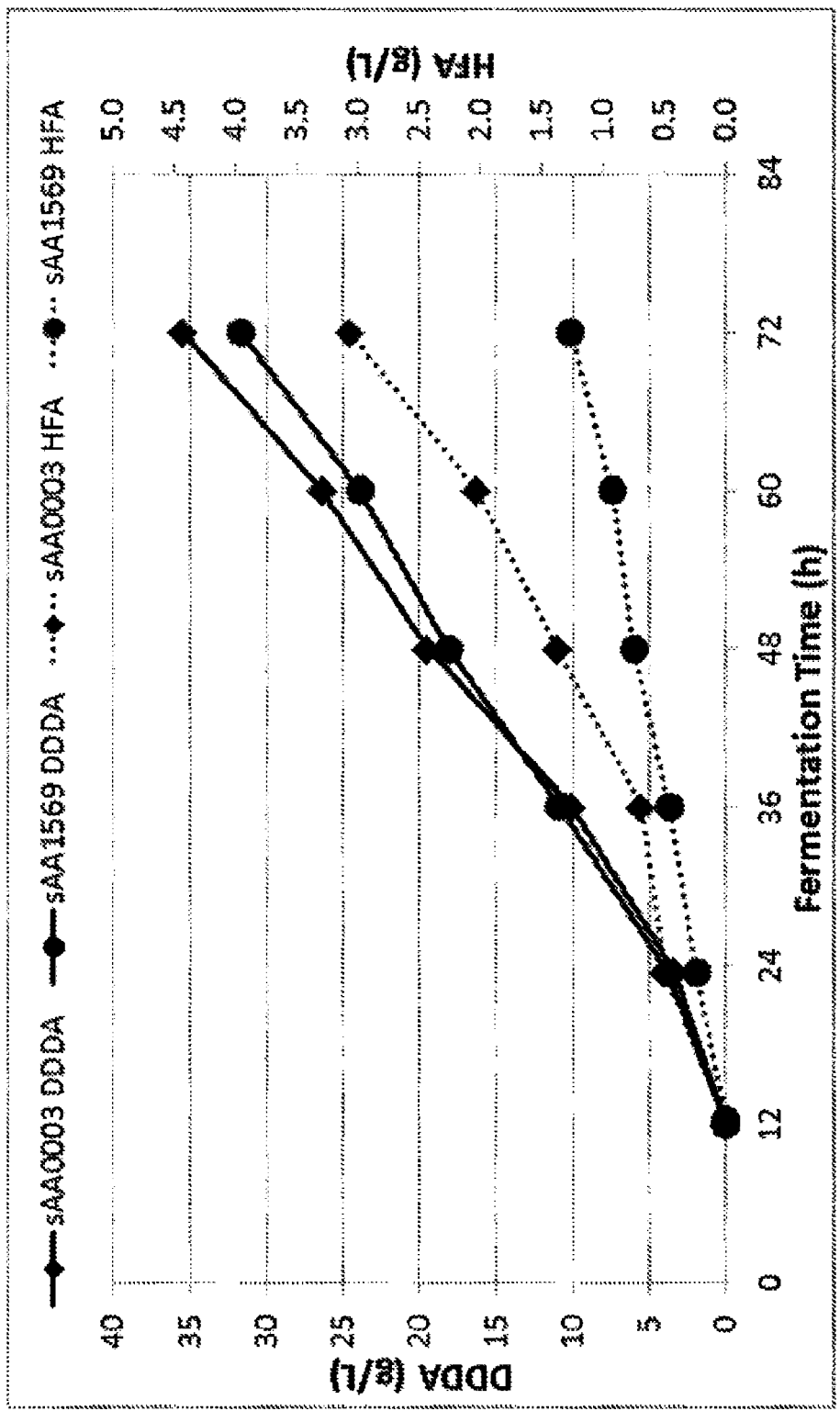

FIG. 26 shows the production of DDDA and 12-hydroxy-dodecanoic acid (HFA) from methyl laurate.

Figure 27:
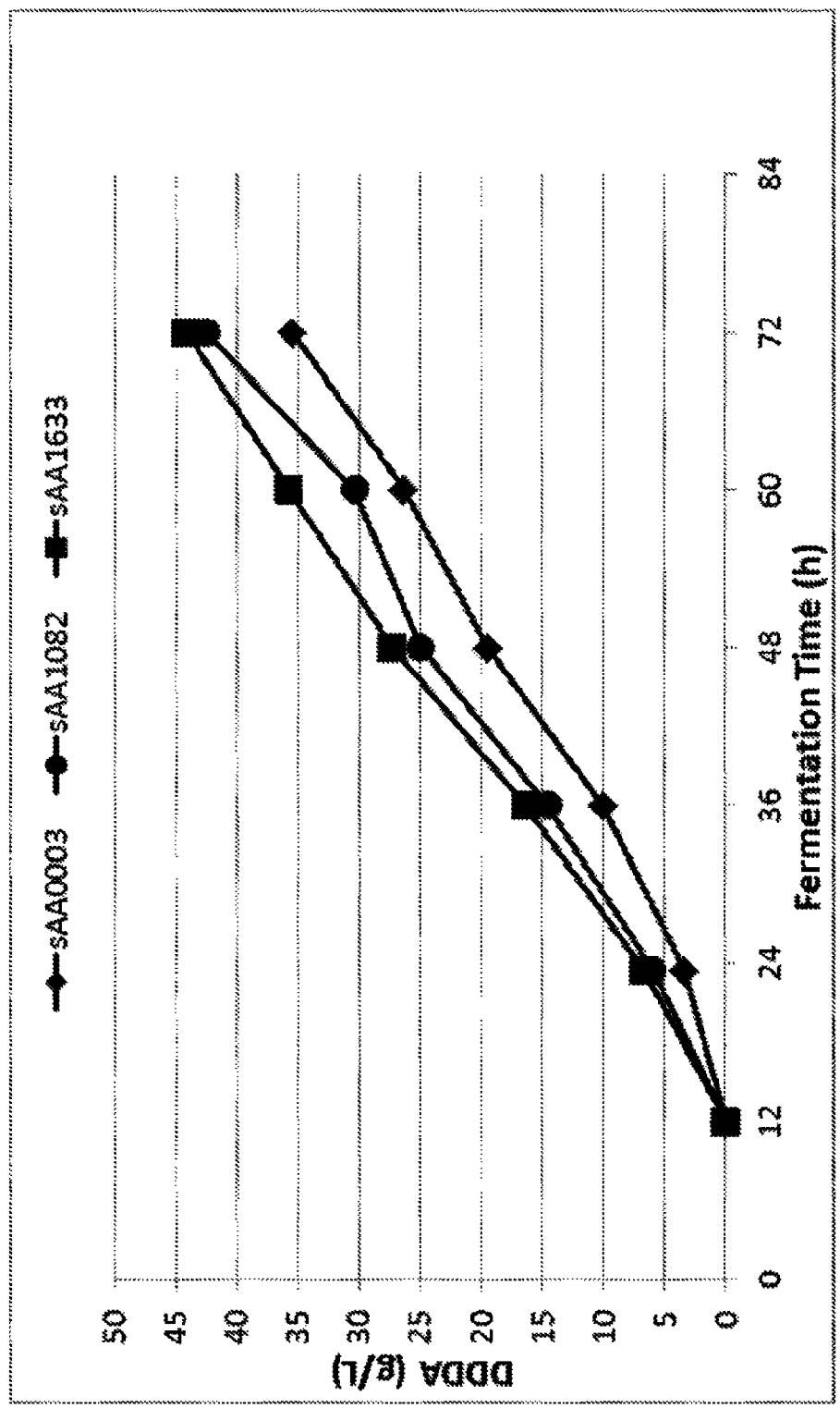

FIG. 27 shows the production of DDDA from methyl laurate.

Figure 28:
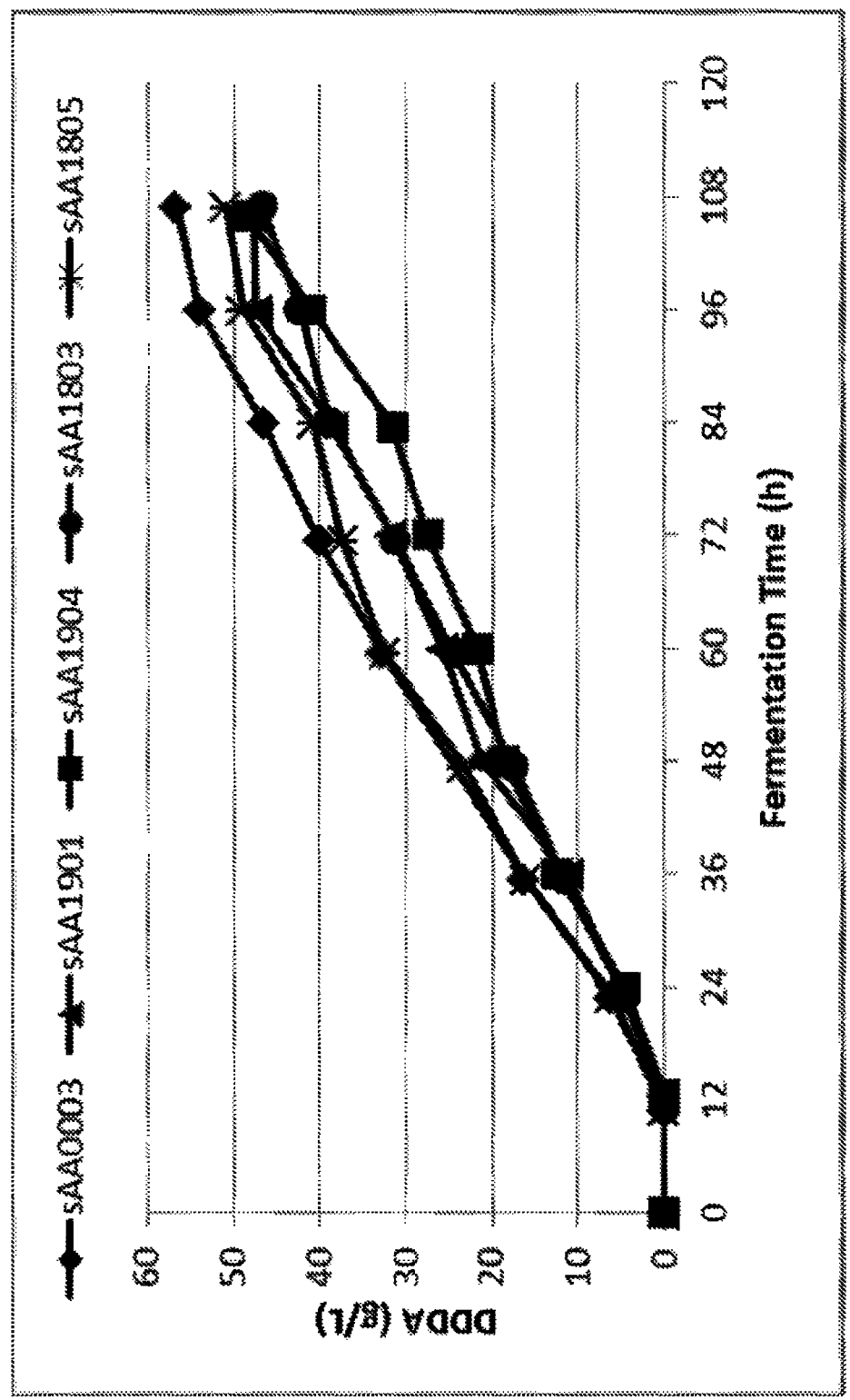

FIG. 28 shows the production of DDDA.

Figure 29:
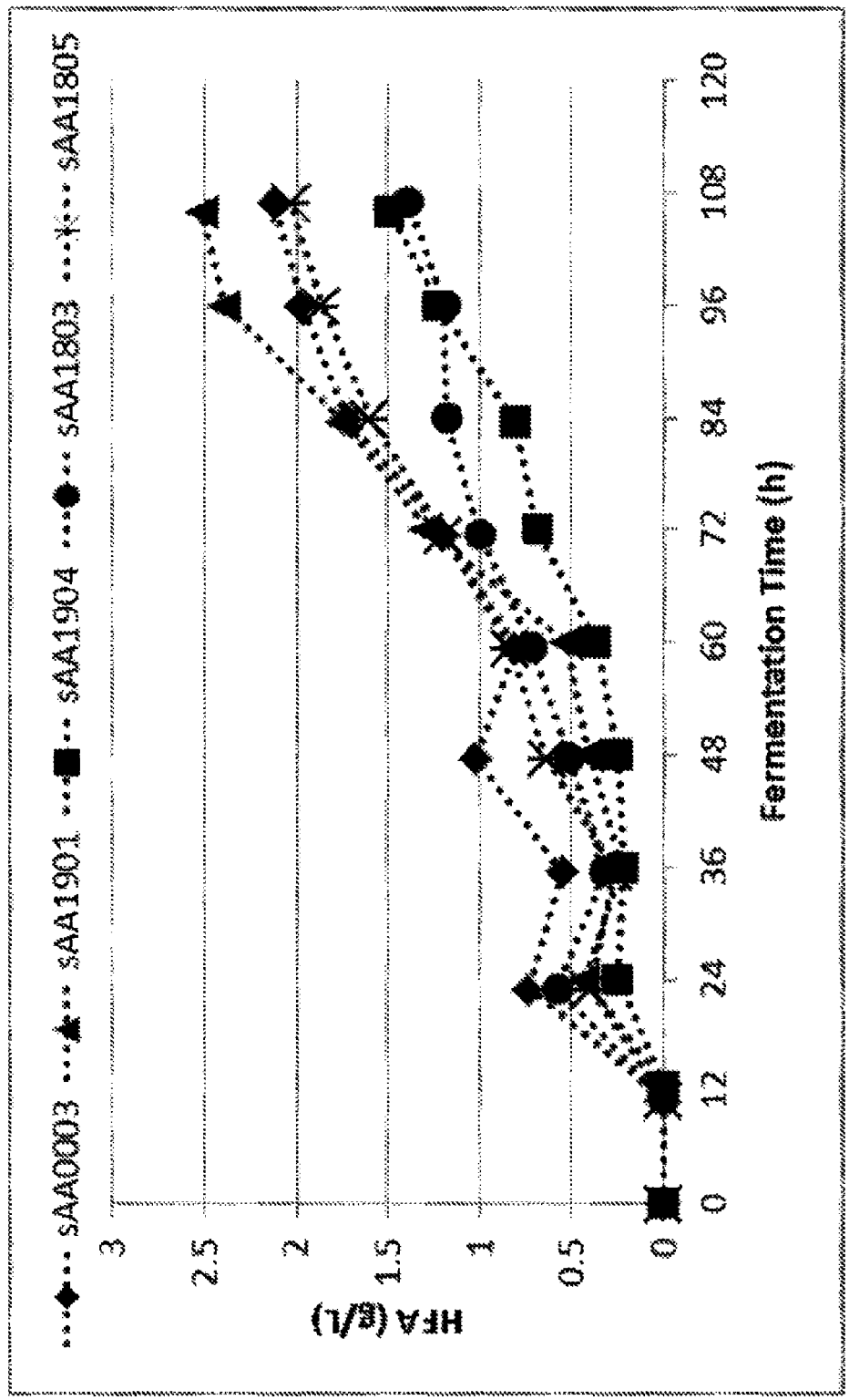

FIG. 29 shows the production of HFAs from methyl laurate.

Figure 30:
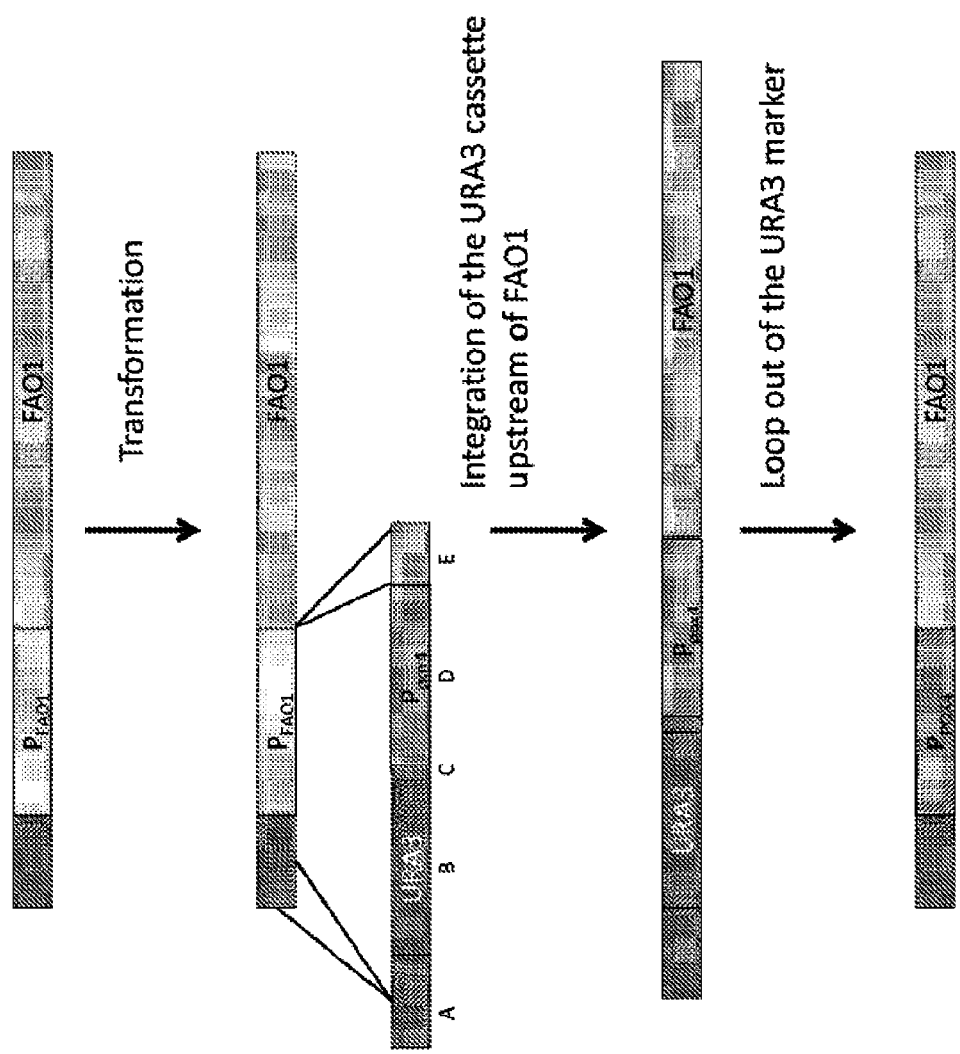

FIG. 30 shows a promoter replacement strategy.

Figure 31:
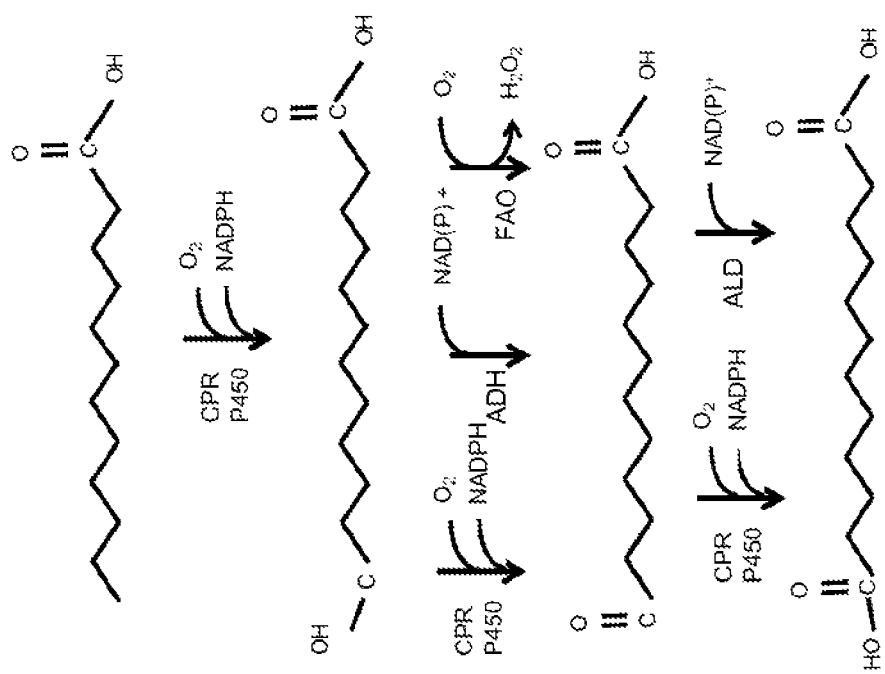

FIG. 31 shows an example of the production of HFAs during the first oxidation step in the omega-oxidation pathway.

Figure 32A:
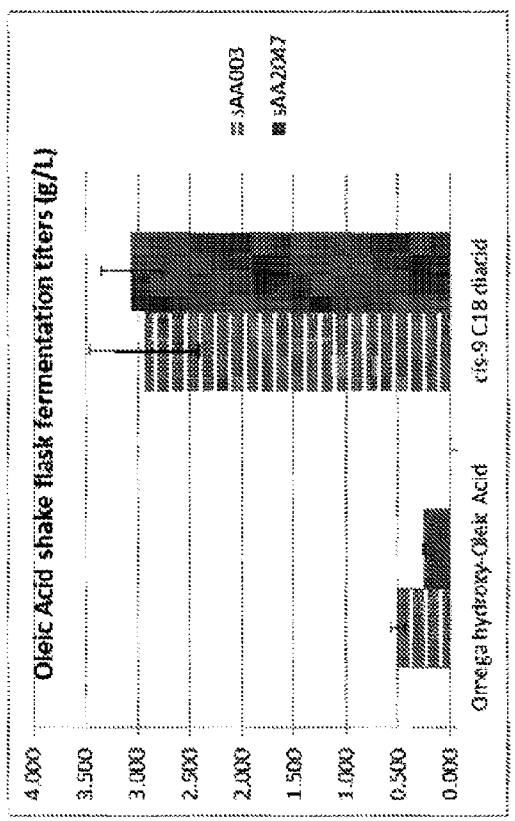

FIG. 32A shows the production of omega hydroxyl-oleic acid and cis-9 C18 diacid from strains sAA003 and sAA2047.

Figure 32B:
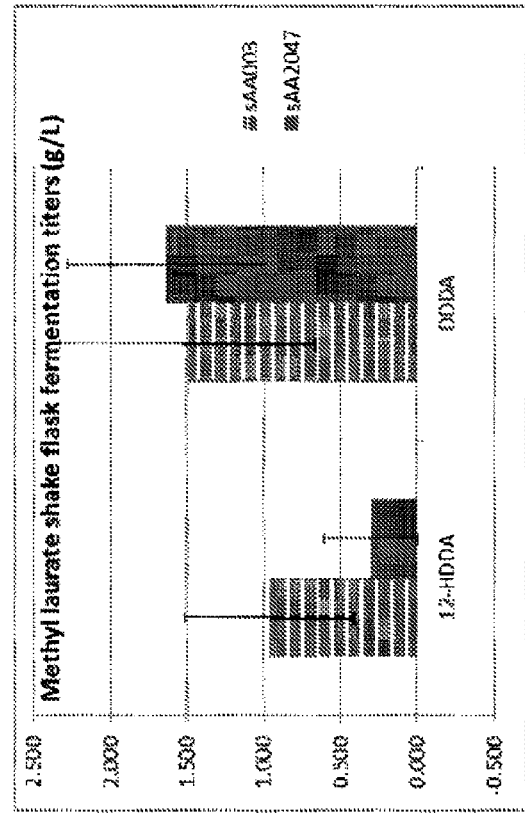

FIG. 32B shows the production of 12-HDDA and DDDA from strains sAA003 and sAA2047.

DETAILED DESCRIPTION

Certain fatty dicarboxylic acids (i.e., diacids, e.g., dodecanedioic acid or sebacic acid) are chemical intermediates in manufacturing processes used to make certain polyamides, polyurethanes and plasticizers, all of which have wide applications in producing items such as antiseptics, top-grade coatings, hot-melt coating and adhesives, painting materials, corrosion inhibitor, surfactant, engineering plastics and can also be used as a starting material in the manufacture of fragrances, for example. For example dodecanedioic acid, also known as 1,12 dodecanedioic acid, and DDDA, is a 12 carbon organic molecule that is a fatty dicarboxylic acid. In another example, sebacic acid, also known as 1,10 decanedioic acid, and 1,8 octanedicarboxylic acid, is a 10 carbon organic molecule that is a fatty dicarboxylic acid.

Provided herein are methods for producing a fatty dicarboxylic acid (also referred to herein as a diacid). Any suitable diacid can be produced, and a diacid produced often includes acid moieties at each terminus of the molecule (e.g., alpha omega diacids). A diacid sometimes is a C4 to a C24 diacid (i.e., a diacid containing 4 carbons to 24 carbons) and sometimes is a C8, C10, C12, C14, C16, C18, or C20 diacid. Yeast and processes herein are capable of producing a diacid containing an odd number of carbons, and sometimes a product contains one or more diacids chosen from a C5, C7, C9, C11, C13, C15, C17, C19, C21 and C23 diacid. A hydrocarbon portion of a diacid sometimes is fully saturated and sometimes a diacid includes one or more unsaturations (e.g., double bonds).

Non-limiting examples of diacids include octanedioic acid, decanedioic acid, dodecanedioic acid, tetradecanedioic acid, hexadecanedioic acid, octadecanedioic acid, eicosanedioic acid) and other organic intermediates using biological systems. Non-limiting examples of fatty dicarboxylic acids include suberic acid (i.e., octanedioic acid, 1,8-octanedioic acid, octanedioic acid, octane-1,8-dioic acid, 1,6-hexanedicarboxylic acid, capryllic diacids), sebacic acid (i.e., 1,10-decanedioic acid, decanedioic acid, decane-1,10-dioic acid, 1,8-octanedicarboxylic acid, capric diacid), dodecanedioic acid (i.e., DDDA, 1,12-dodecanedioic acid, dodecanedioic acid, dodecane-1,12-dioic acid, 1,10-decanedicarboxylic acid, decamethylenedicaboxylic acid, 1,10-dicarboxydecane, lauric diacid), tetradecanedioic acid (i.e., TDDA, 1,14-tetradecanedioic acid, tetradecanedioic acid, tetradecane-1,14-dioic acid, 1,12-dodecanedicarboxylic acid, myristic diacid), thapsic acid (i.e., hexadecanedioic acid, 1,16-hexadecanedioic acid, hexadecanedioic acid, hexadecane-1,16-dioic acid, 1,14-tetradecanedicarboxylic acid, palmitic diacid), cis-9-hexadecenedioic acid (i.e., palmitoleic diacids), octadecanedioic acid (i.e., 1,18-octadecanedioic acid, octadecanedioic acid, octadecane-1,18-dioic acid, 1,16-hexadecanedicarboxylic acid, stearic diacid), cis-9-octadecenedioic acid (i.e., oleic diacids), cis-9,12-octadecenedioic acid (i.e., linoleic diacids), cis-9,12,15-octadecenedioic acid (i.e., linolenic diacids), arachidic diacid (i.e., eicosanoic diacid, icosanoic diacid), 11-eicosenoic diacid (i.e., cis-11-eicosenedioic acid), 13-eicosenoic diacids (i.e., cis-13-eicosenedioic acid), arachidonic diacid (i.e., cis-5,8,11,14-eicosatetraenedioic acid).

A genetically modified yeast can be provided with a feedstock to produce a diacid, and the feedstock sometimes includes a substantially pure aliphatic molecule from which the diacid is produced. In certain embodiments, the feedstock contains a mixed set of aliphatic molecules from which diacids may be produced. In some embodiments, an aliphatic molecule in the feedstock is the predominant aliphatic species and sometimes a particular diacid produced from that aliphatic molecule is the predominant diacid species produced. A predominant species generally is 51% or more by weight of aliphatic molecule species in a feedstock or 51% or more by weight of diacid species in a product (e.g., about 55% or more, 60% or more, 65% or more, 70% or more, 75% or more, 80% or more, 85% or more, 90% or more or 95% or more).

Such production systems may have significantly less environmental impact and could be economically competitive with current manufacturing systems. Thus, provided in part herein are methods for manufacturing a fatty dicarboxylic acid (e.g., octanedioic acid, decanedioic acid, dodecanedioic acid, tetradecanedioic acid, hexadecanedioic acid, octadecanedioic acid, eicosanedioic acid) by engineered microorganisms. In some embodiments microorganisms are engineered to contain at least one heterologous gene encoding an enzyme, where the enzyme is a member of a novel and/or altered pathway engineered into the microorganism. In certain embodiments, an organism may be selected for elevated activity of a native enzyme.

Microorganisms

A microorganism selected often is suitable for genetic manipulation and often can be cultured at cell densities useful for industrial production of a target fatty dicarboxylic acid product. A microorganism selected often can be maintained in a fermentation device.

The term "engineered microorganism" as used herein refers to a modified microorganism that includes one or more activities distinct from an activity present in a microorganism utilized as a starting point (hereafter a "host microorganism"). An engineered microorganism includes a heterologous polynucleotide in some embodiments, and in certain embodiments, an engineered organism has been subjected to selective conditions that alter an activity, or introduce an activity, relative to the host microorganism. Thus, an engineered microorganism has been altered directly or indirectly by a human being. A host microorganism sometimes is a native microorganism, and at times is a microorganism that has been engineered to a certain point.

In some embodiments an engineered microorganism is a single cell organism, often capable of dividing and proliferating. A microorganism can include one or more of the following features: aerobe, anaerobe, filamentous, non-filamentous, monoploid, dipoid, auxotrophic and/or non-auxotrophic. In certain embodiments, an engineered microorganism is a prokaryotic microorganism (e.g., bacterium), and in certain embodiments, an engineered microorganism is a non-prokaryotic microorganism. In some embodiments, an engineered microorganism is a eukaryotic microorganism (e.g., yeast, fungi, amoeba). In some embodiments, an engineered microorganism is a fungus. In some embodiments, an engineered organism is a yeast.

Any suitable yeast may be selected as a host microorganism, engineered microorganism, genetically modified organism or source for a heterologous or modified polynucleotide. Yeast include, but are not limited to, *Yarrowia* yeast (e.g., *Y. lipolytica* (formerly classified as *Candida lipolytica*)), *Candida* yeast (e.g., *C. revkaufi, C. viswanathii, C. pulcherrima, C. tropicalis, C. utilis*), *Rhodotorula* yeast (e.g., *R. glutinus, R. graminis*), *Rhodosporidium* yeast (e.g., *R. toruloides*), *Saccharomyces* yeast (e.g., *S. cerevisiae, S. bayanus, S. pastorianus, S. carlsbergensis*), *Cryptococcus* yeast, *Trichosporon* yeast (e.g., *T. pullans, T. cutaneum*), *Pichia* yeast (e.g., *P. pastoris*) and *Lipomyces* yeast (e.g., *L. starkeyii, L. lipoferus*). In some embodiments, a suitable yeast is of the genus *Arachniotus, Aspergillus, Aureobasidium, Auxarthron, Blastomyces, Candida, Chrysosporuim, Chrysosporuim Debaryomyces, Coccidiodes, Cryptococcus, Gymnoascus, Hansenula, Histoplasma, Issatchenkia, Kluyveromyces, Lipomyces, Lssatchenkia, Microsporum, Myxotrichum, Myxozyma, Oidiodendron, Pachysolen, Penicillium, Pichia, Rhodosporidium, Rhodotorula, Rhodotorula, Saccharomyces, Schizosaccharomyces, Scopulariopsis, Sepedonium, Trichosporon,* or *Yarrowia*. In some embodiments, a suitable yeast is of the species *Arachniotus flavoluteus, Aspergillus flavus, Aspergillus fumigatus, Aspergillus niger, Aureobasidium pullulans, Auxarthron thaxteri, Blastomyces dermatitidis, Candida albicans, Candida dubliniensis, Candida famata, Candida glabrata, Candida guilliermondii, Candida kefyr, Candida krusei, Candida lambica, Candida lipolytica, Candida lustitaniae, Candida parapsilosis, Candida pulcherrima, Candida revkaufi, Candida rugosa, Candida tropicalis, Candida utilis, Candida viswanathii, Candida xestobii, Chrysosporuim keratinophilum, Coccidiodes immitis, Cryptococcus albidus* var. *diffluens, Cryptococcus laurentii, Cryptococcus neofomans, Debaryomyces hansenii, Gymnoascus dugwayensis, Hansenula anomala, Histoplasma capsulatum, Issatchenkia occidentalis, Isstachenkia orientalis, Kluyveromyces lactis, Kluyveromyces marxianus, Kluyveromyces thermotolerans, Kluyveromyces waltii, Lipomyces lipoferus, Lipomyces starkeyii, Microsporum gypseum, Myxotrichum deflexum, Oidiodendron echinulatum, Pachysolen tannophilis, Penicillium notatum, Pichia anomala, Pichia pastoris, Pichia stipitis, Rhodosporidium toruloides, Rhodotorula glutinus, Rhodotorula graminis, Saccharomyces cerevisiae, Saccharomyces kluyveri, Schizosaccharomyces pombe, Scopulariopsis acremonium, Sepedonium chrysospermum, Trichosporon cutaneum, Trichosporon pullans, Yarrowia lipolytica,* or *Yarrowia lipolytica* (formerly classified as *Candida lipolytica*). In some embodiments, a yeast is a *Y. lipolytica* strain that includes, but is not limited to, ATCC20362, ATCC8862, ATCC18944, ATCC20228, ATCC76982 and LGAM S(7)1 strains (Papanikolaou S., and Aggelis G., Bioresour. Technol. 82(1):43-9 (2002)). In certain embodiments, a yeast is a *Candida* species (i.e., *Candida* spp.) yeast. Any suitable *Candida* species can be used and/or genetically modified for production of a fatty dicarboxylic acid (e.g., octanedioic acid, decanedioic acid, dodecanedioic acid, tetradecanedioic acid, hexadecanedioic acid, octadecanedioic acid, eicosanedioic acid). In some embodiments, suitable *Candida* species include, but are not limited to *Candida albicans, Candida dubliniensis, Candida famata, Candida glabrata, Candida guilliermondii, Candida kefyr, Candida krusei, Candida lambica, Candida lipolytica, Candida lustitaniae, Candida parapsilosis, Candida pulcherrima, Candida revkaufi, Candida rugosa, Candida tropicalis, Candida utilis, Candida viswanathii, Candida xestobii* and any other *Candida* spp. yeast described herein. Non-limiting examples of *Candida* spp. strains include, but are not limited to, sAA001 (ATCC20336), sAA002 (ATCC20913), sAA003 (ATCC20962), sAA496 (US2012/0077252), sAA106 (US2012/0077252), SU-2 (ura3-/ura3-), H5343 (beta oxidation blocked; U.S. Pat. No. 5,648,247) strains. Any suitable strains from *Candida* spp. yeast may be utilized as parental strains for genetic modification.

Yeast genera, species and strains are often so closely related in genetic content that they can be difficult to distinguish, classify and/or name. In some cases strains of *C. lipolytica* and *Y. lipolytica* can be difficult to distinguish, classify and/or name and can be, in some cases, considered the same organism. In some cases, various strains of *C. tropicalis* and *C. viswanathii* can be difficult to distinguish, classify and/or name (for example see Arie et. al., J. Gen. Appl. Microbiol., 46, 257-262 (2000). Some *C. tropicalis* and *C. viswanathii* strains obtained from ATCC as well as from other commercial or academic sources can be considered equivalent and equally suitable for the embodiments described herein. In some embodiments, some parental stains of *C. tropicalis* and *C. viswanathii* are considered to differ in name only.

Any suitable fungus may be selected as a host microorganism, engineered microorganism or source for a heterologous polynucleotide. Non-limiting examples of fungi include, but are not limited to, *Aspergillus* fungi (e.g., *A. parasiticus, A. nidulans*), *Thraustochytrium* fungi, *Schizochytrium* fungi and *Rhizopus* fungi (e.g., *R. arrhizus, R. oryzae, R. nigricans*). In some embodiments, a fungus is an *A. parasiticus* strain that includes, but is not limited to, strain ATCC24690, and in certain embodiments, a fungus is an *A. nidulans* strain that includes, but is not limited to, strain ATCC38163.

Any suitable prokaryote may be selected as a host microorganism, engineered microorganism or source for a heterologous polynucleotide. A Gram negative or Gram positive bacteria may be selected. Examples of bacteria include, but are not limited to, *Bacillus* bacteria (e.g., *B. subtilis, B. megaterium*), *Acinetobacter* bacteria, *Norcardia* bacteria, *Xanthobacter* bacteria, *Escherichia* bacteria (e.g., *E. coli* (e.g., strains DH10B, Stbl2, DH5-alpha, DB3, DB3.1), DB4, DB5, JDP682 and ccdA-over (e.g., U.S. application Ser. No. 09/518,188)), *Streptomyces* bacteria, *Erwinia* bacteria, *Klebsiella* bacteria, *Serratia* bacteria (e.g., *S. marcessans*), *Pseudomonas* bacteria (e.g., *P. aeruginosa*), *Salmonella* bacteria (e.g., *S. typhimurium, S. typhi*), *Megasphaera* bacteria (e.g., *Megasphaera elsdenii*). Bacteria also include, but are not limited to, photosynthetic bacteria (e.g., green non-sulfur bacteria, *Choroflexus* bacteria (e.g., *C. aurantiacus*), *Chloronema* bacteria (e.g., *C. gigateum*)), green sulfur bacteria (e.g., *Chlorobium* bacteria (e.g., *C. limicola*)), *Pelodictyon* bacteria (e.g., *P. luteolum*), purple sulfur bacteria (e.g., *Chromatium* bacteria (e.g., *C. okenii*)), and purple non-sulfur bacteria (e.g., *Rhodospirillum* bacteria (e.g., *R. rubrum*), *Rhodobacter* bacteria (e.g., *R. sphaeroides, R. capsulatus*), and *Rhodomicrobium* bacteria (e.g., *R. vanellii*)).

Cells from non-microbial organisms can be utilized as a host microorganism, engineered microorganism or source for a heterologous polynucleotide. Examples of such cells, include, but are not limited to, insect cells (e.g., *Drosophila* (e.g., *D. melanogaster*), *Spodoptera* (e.g., *S. frugiperda* Sf9 or Sf21 cells) and *Trichoplusa* (e.g., High-Five cells); nematode cells (e.g., *C. elegans* cells); avian cells; amphibian cells (e.g., *Xenopus laevis* cells); reptilian cells; mammalian cells (e.g., NIH3T3, 293, CHO, COS, VERO, C127, BHK, Per-C6, Bowes melanoma and HeLa cells); and plant cells (e.g., *Arabidopsis thaliana, Nicotania tabacum, Cuphea acinifolia, Cuphea aequipetala, Cuphea angustifolia, Cuphea appendiculata, Cuphea avigera, Cuphea avigera* var. *pulcherrima, Cuphea axilliflora, Cuphea bahiensis, Cuphea baillonis, Cuphea brachypoda, Cuphea bustamanta, Cuphea calcarata, Cuphea calophylla, Cuphea calophylla* subsp. *mesostemon, Cuphea carthagenensis, Cuphea circaeoides, Cuphea confertiflora, Cuphea cordata, Cuphea crassiflora, Cuphea cyanea, Cuphea decandra, Cuphea denticulata, Cuphea disperma, Cuphea epilobiifolia, Cuphea ericoides, Cuphea flava, Cuphea flavisetula, Cuphea fuchsiifolia, Cuphea gaumeri, Cuphea glutinosa, Cuphea heterophylla, Cuphea hookeriana, Cuphea hyssopifolia* (Mexican-heather), *Cuphea hyssopoides, Cuphea ignea, Cuphea ingrata, Cuphea jorullensis, Cuphea lanceolata, Cuphea linarioides, Cuphea llavea, Cuphea lophostoma, Cuphea lutea, Cuphea lutescens, Cuphea melanium, Cuphea melvilla, Cuphea micrantha, Cuphea micropetala, Cuphea mimuloides, Cuphea nitidula, Cuphea palustris, Cuphea parsonsia, Cuphea pascuorum, Cuphea paucipetala, Cuphea procumbens, Cuphea pseudosilene, Cuphea pseudovaccinium, Cuphea pulchra, Cuphea racemosa, Cuphea repens, Cuphea salicifolia, Cuphea salvadorensis, Cuphea schumannii, Cuphea sessiliflora, Cuphea sessilifolia, Cuphea setosa, Cuphea spectabilis, Cuphea spermacoce, Cuphea splendida, Cuphea splendida* var. *viridiflava, Cuphea strigulosa, Cuphea subuligera, Cuphea teleandra, Cuphea thymoides, Cuphea tolucana, Cuphea urens, Cuphea utriculosa, Cuphea viscosissima, Cuphea watsoniana, Cuphea wrightii, Cuphea lanceolata*)).

Microorganisms or cells used as host organisms or source for a heterologous polynucleotide are commercially available. Microorganisms and cells described herein, and other suitable microorganisms and cells are available, for example, from Invitrogen Corporation (Carlsbad, Calif.), American Type Culture Collection (Manassas, Va.), and Agricultural Research Culture Collection (NRRL; Peoria, Ill.).

Host microorganisms and engineered microorganisms may be provided in any suitable form. For example, such microorganisms may be provided in liquid culture or solid culture (e.g., agar-based medium), which may be a primary culture or may have been passaged (e.g., diluted and cultured) one or more times. Microorganisms also may be provided in frozen form or dry form (e.g., lyophilized). Microorganisms may be provided at any suitable concentration.

Carbon Processing Pathways and Activities

Figure 1:
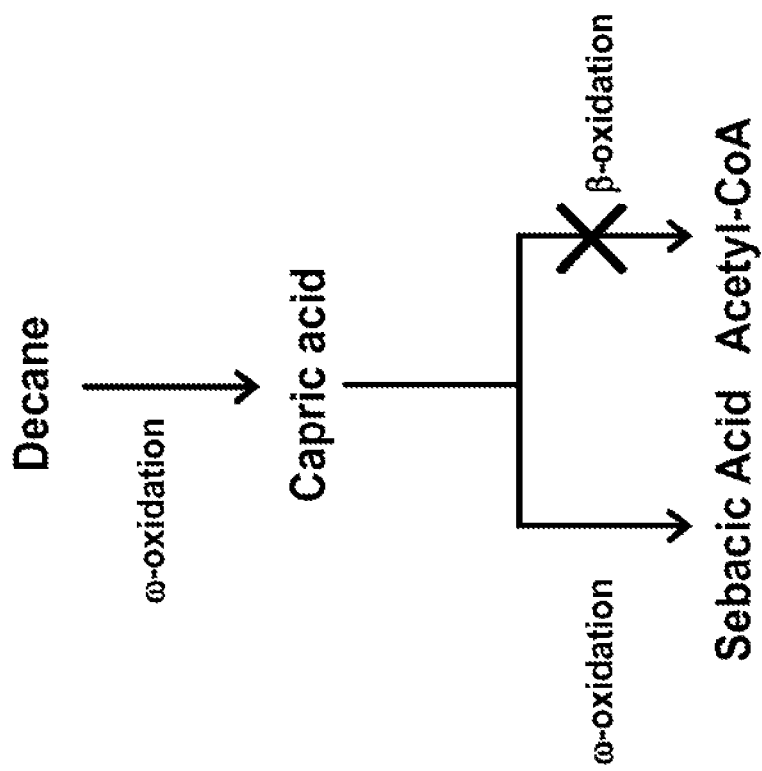
FIG. 1 is a schematic representation of the conversion of decane to sebacic acid in a beta-oxidation blocked microorganism. Capric acid is formed as an intermediate during omega oxidation.
Figure 2:
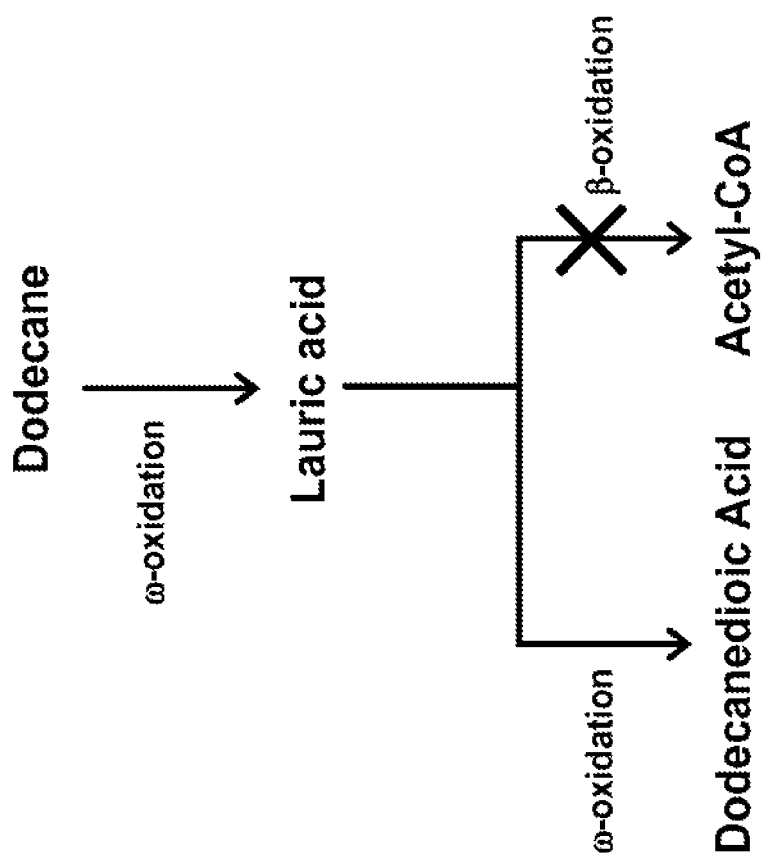
FIG. 2 is a schematic representation of the conversion of dodecane to dodecanedioic acid in a beta-oxidation blocked microorganism. Lauric acid is formed as an intermediate during omega oxidation.
Figure 3:
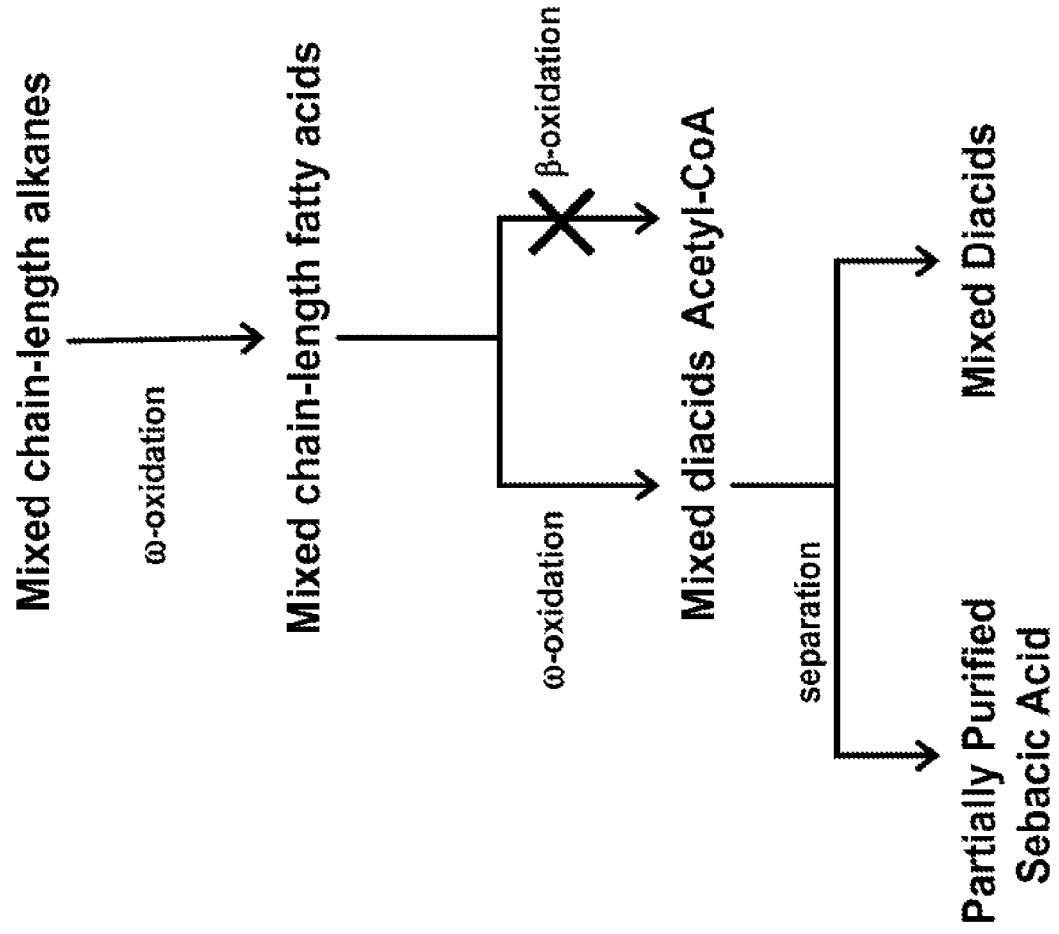
FIG. 3 is a schematic representation of the conversion of a feedstock containing mixed chain-length alkanes to mixed diacids products, including sebacic acid in a beta-oxidation blocked microorganism. Mixed chain-length fatty acids are formed as intermediates during omega oxidation. Sebacic acid can be separated from other diacid products by the use of appropriate separation techniques.
Figure 4:
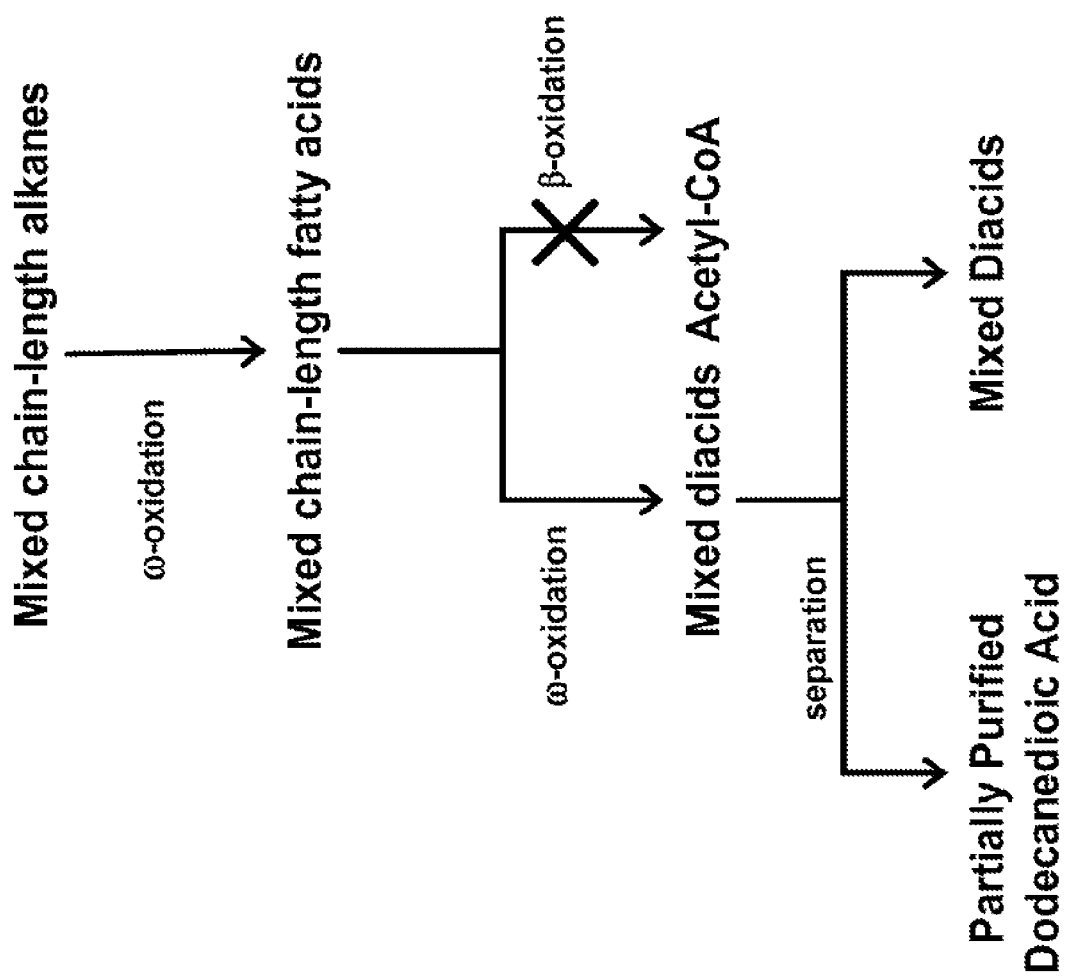
FIG. 4 is a schematic representation of the conversion of a feedstock containing mixed chain-length alkanes to mixed diacids products, including dodecanedioic acid in a beta-oxidation blocked microorganism. Mixed chain-length fatty acids are formed as intermediates during omega oxidation. Dodecanedioic acid can be separated from other diacid products by the use of appropriate separation techniques.
Figure 5:
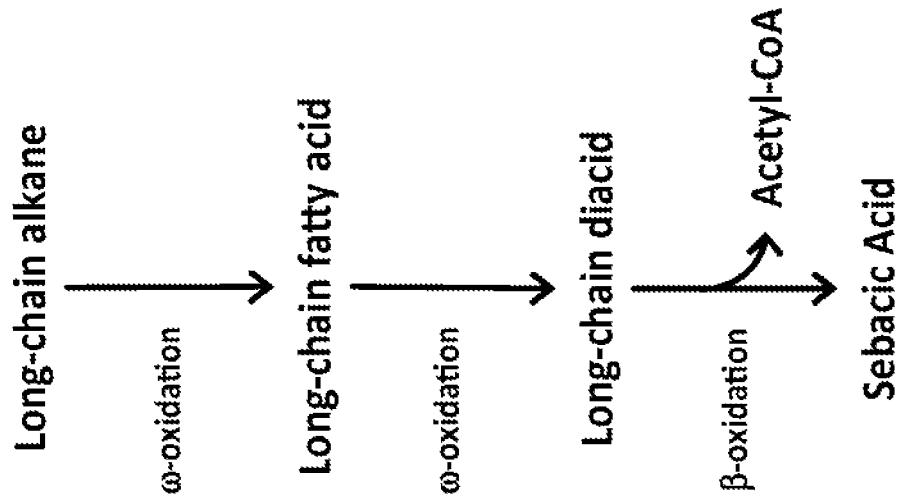
FIG. 5 is a schematic representation of the conversion of a long-chain alkane into sebacic acid in a partially beta-oxidation blocked microorganism. The long-chain alkane is first converted into a long-chain fatty acid and then into a long-chain diacid by activities in the omega-oxidation pathway. The long-chain diacid can be converted to sebacic acid by activities in the beta-oxidation pathway, with the simultaneous generation of acetyl-CoA.
Figure 6:
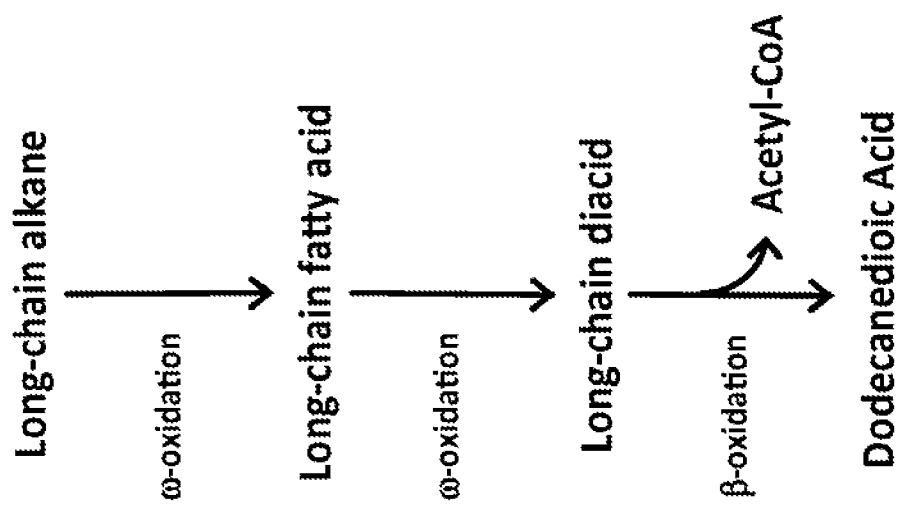
FIG. 6 is a schematic representation of the conversion of a long-chain alkane into dodecanedioic acid in a partially beta-oxidation blocked microorganism. The long-chain alkane is first converted into a long-chain fatty acid and then into a long-chain diacid by activities in the omega-oxidation pathway. The long-chain diacid can be converted to dodecanedioic acid by activities in the beta-oxidation pathway, with the simultaneous generation of acetyl-CoA.
Figure 7:
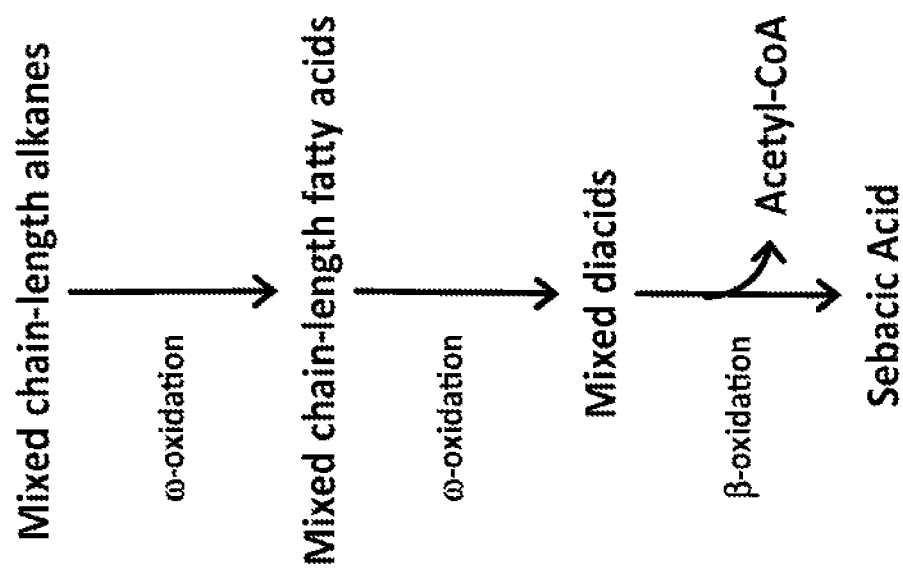
FIG. 7 is a schematic representation of the conversion of a feedstock containing mixed chain-length alkanes into sebacic acid in a partially beta-oxidation blocked microorganism. The mixed chain-length alkanes are first converted into mixed chain-length fatty acids and then mixed diacids by activities in the omega-oxidation pathway. Mixed diacids can be converted to sebacic acid by activities in the beta-oxidation pathway, with the simultaneous generation of acetyl-CoA.
Figure 8:
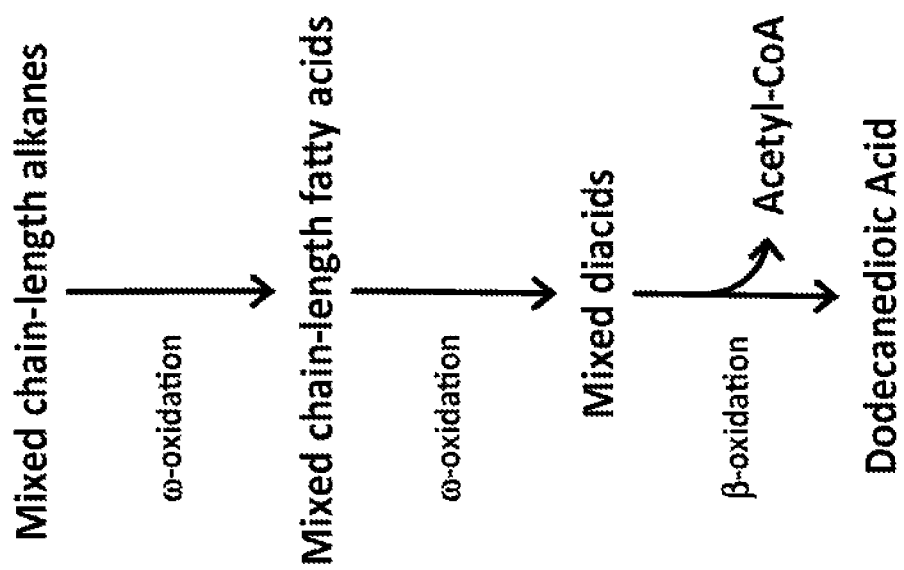
FIG. 8 is a schematic representation of the conversion of a feedstock containing mixed chain-length alkanes into dodecanedioic acid in a partially beta-oxidation blocked microorganism. The mixed chain-length alkanes are first converted into mixed chain-length fatty acids and then mixed diacids by activities in the omega-oxidation pathway. Mixed diacids can be converted to dodecanedioic acid by activities in the beta-oxidation pathway, with the simultaneous generation of acetyl-CoA.

FIGS. 1-8 schematically illustrate non-limiting embodiments of engineered pathways that can be used to produce a fatty dicarboxylic acid (e.g., octanedioic acid, decanedioic acid, dodecanedioic acid, tetradecanedioic acid, hexadecanedioic acid, octadecanedioic acid, eicosanedioic acid) from various starting carbon sources or feedstocks. FIG. 1 depicts an embodiment of a non-limiting engineered biological pathway for producing sebacic acid in microorganisms having a fully blocked beta-oxidation pathway, using decane as the carbon source starting material. FIG. 2 depicts an embodiment of a non-limiting engineered biological pathway for producing dodecanedioic acid in microorganisms having a fully blocked beta-oxidation pathway, using dodecane as the carbon source starting material. FIG. 3 and FIG. 4 depict an embodiment of a non-limiting engineered biological pathway for producing mixed chain-length diacids in a microorganism having a fully blocked beta-oxidation pathway, using mixed chain-length alkanes as the carbon source starting material. Sebacic acid (FIG. 3) and dodecanedioic acid (FIG. 4) can be separated and/or purified away from other diacid products using a suitable combination of centrifugation, organic solvent extraction, chromatography, and/or other purification/separation techniques. FIG. 5 and FIG. 6 depict an embodiment of a non-limiting engineered biological pathway for producing sebacic acid (FIG. 5) and dodecanedioic acid (FIG. 6) in microorganisms having a partially blocked beta oxidation pathway, using long-chain alkanes as the carbon source starting material. FIG. 7 and FIG. 8 depict an embodiment of a non-limiting engineered biological pathway for producing sebacic acid (FIG. 7) and dodecanedioic acid (FIG. 8) in microorganisms having a partially blocked beta oxidation pathway, using mixed-chain length alkanes as the carbon source starting material.

The alkane carbon source starting materials are initially metabolized using naturally occurring and/or engineered activities in naturally occurring and/or engineered pathways to yield an intermediate alcohol which can then be converted to a carboxylic acid (e.g., fatty acid) by the action of other naturally occurring and/or engineered activities in the omega-oxidation pathway depicted in FIGS. 1-8.

Alkanes are omega-hydroxylated by the activity of cytochrome P450 enzymes, thereby generating the equivalent chain-length alcohol derivative of the starting alkane carbon source material. In certain embodiments, a cytochrome P450 activity can be increased by increasing the number of copies of a cytochrome P450 gene (e.g., 2, 3, 4, 5, 6, 7, 8, 9, 10, 15, 20, 25 or more copies of the gene), by increasing the activity of a promoter that regulates transcription of a cytochrome P450 gene, or by increasing the number of copies of a cytochrome P450 gene and increasing the activity of a promoter that regulates transcription of a cytochrome P450 gene, thereby increasing the production of target product (e.g., sebacic or dodecanedioic acid) via increased activity of one or more cytochrome P450 enzymes. In some embodiments, a cytochrome P450 enzyme is endogenous to the host microorganism. One or more cytochrome P450 activities can be added and/or increased dependent on the carbon source starting material, in certain embodiments. Cytochrome P450's sometimes exhibit increased activities in response to stimulation by certain feedstocks or carbon source starting materials. In some embodiments, an engineered microorganism includes an increased number of copies of one or more cytochrome P450s that are stimulated by a chosen carbon source starting material or feedstock. Cytochrome P450 responsiveness to a chosen starting carbon source or feedstock can be determined using any suitable assay. Non-limiting examples of assays suitable for identification of cytochrome P450 responsiveness to a starting carbon source or feedstock include RT-PCR or qRT-PCR after the host microorganism has been exposed to the chosen carbon source or feedstock for varying amounts of time.

Cytochrome P450 is reduced by the activity of cytochrome P450 reductase (CPR), thereby recycling cytochrome P450 to allow further enzymatic activity. In certain embodiments, the CPR enzyme is endogenous to the host microorganism. In some embodiments, host CPR activity can be increased by increasing the number of copies of a CPR gene (e.g., 2, 3, 4, 5, 6, 7, 8, 9, 10, 15, 20, 25 or more copies of the gene), by increasing the activity of a promoter that regulates transcription of a CPR gene, or by increasing the number of copies of a CPR gene and increasing the activity of a promoter that regulates transcription of a CPR gene, thereby increasing the production of target product (e.g., sebacic or dodecanedioic acid) via increased recycling of cytochrome P450. In certain embodiments, the promoter can be a heterologous promoter (e.g., endogenous or exogenous promoter). In some embodiments, the CPR gene is heterologous and exogenous and can be isolated from any suitable organism. Non-limiting examples of organisms from which a CPR gene can be isolated include *C. tropicalis*, *S. cerevisiae* and *Bacillus megaterium*.

Oxidation of the alcohol to an aldehyde may be performed by an enzyme in the fatty alcohol oxidase family (e.g., long-chain fatty alcohol oxidase EC 1.1.3.20), or an enzyme in the alcohol dehydrogenase family (e.g., fatty alcohol dehydrogenase; EC 1.1.1.1). The aldehyde may be oxidized to a carboxylic acid (e.g., sebacic or dodecanedioic acid) by the activity of the enzyme aldehyde dehydrogenase (e.g., long-chain-aldehyde dehydrogenase or fatty aldehyde dehydrogenase; EC 1.2.1.48). In some embodiments, the long chain fatty alcohol oxidase, fatty alcohol dehydrogenase and/or the long-chain-aldehyde dehydrogenase exist in a host organism. Flux through these two steps may sometimes be augmented by increasing the copy number of the enzymes, or by increasing the activity of the promoter transcribing the genes. In some embodiments alcohol and aldehyde dehydrogenases specific for 10, 12 or 14 carbon substrates may be isolated from another organism, and inserted into the host organism.

FIG. 1 depicts a non-limiting embodiment of an engineered biological pathway for making sebacic acid using decane (e.g., a C10 alkane) as the carbon source starting material. Due to the carbon chain length of decane, no chain shortening is necessary to arrive at the 10 carbon diacid, sebacic acid. Thus a fully beta oxidation blocked microorganism can be utilized to minimize conversion of the desired 10 carbon diacid into diacids having shorter chain lengths.

FIG. 2 depicts a non-limiting embodiment of an engineered biological pathway for making dodecanedioic acid using dodecane (e.g., a C12 alkane) as the carbon source starting material. Due to the carbon chain length of dodecane, no chain shortening is necessary to arrive at the 12 carbon diacid, dodecanedioic acid. Thus a fully beta oxidation blocked microorganism can be utilized to minimize conversion of the desired 12 carbon diacid into diacids having shorter chain lengths.

FIGS. 3 and 4 depict a non-limiting embodiment of an engineered biological pathway for generating a mixed population of diacid (fatty dicarboxylic acid) products, including sebacid acid (FIG. 3) and dodecanedioic acid (FIG. 4), using a carbon source or feedstock that contains mixed-chain-length alkanes as the carbon source starting material. Any suitable mixed-chain-length alkane, fatty alcohol, mixed chain length fatty alcohol feedstock, fatty acid, mixed fatty acid feedstock, paraffin, fat or oil can be used. In some embodiments, the distribution of carbon chain lengths in the starting material is substantially similar to the desired carbon chain length distribution in the mixed diacid product. In certain embodiments, the feedstock is enriched for a desired chain length. In some embodiments, the enriched fraction is enriched for carbon chain lengths of about 10 carbons. In some embodiments, the enriched fraction is enriched for carbon chain lengths of about 12 carbons. Because, in some embodiments, the diacids generated have substantially the same chain lengths as the chain lengths found in the carbon source starting material, a fully beta-oxidation blocked microorganism can be utilized to minimize conversion of the diacids of desired chain length into diacids of shorter chain lengths. The lower part of the pathways in FIG. 3 and FIG. 4 show the separation of sebacic acid and dodecanedioic acid, respectively, away from the mixed diacid products by the use of separation techniques described herein, or those known in the art.

In certain embodiments involving genetically modified organisms having partially blocked beta-oxidation pathways (see FIGS. 5-8), feedstocks suitable for use include, but are not limited to, fatty acid distillates or soapstocks of renewable oils (palm oil fatty acid distillate, soybean oil soapstock, coconut oil soapstock), renewable oils (coconut oil, palm oil, palm kernel oil, soybean oil, corn oil, etc.), fatty acids of chain length equal to or greater than C10 (in substantially single form (e.g., in substantially pure form) or in mixture form, alkanes of chain length equal to or greater than C10 in substantially single form (e.g., substantially pure form) or in mixture form.

Carbon sources with longer chain lengths (e.g., 12 carbons or greater in length) can be metabolized using naturally occurring and/or engineered pathways to yield molecules that can be further metabolized using the beta oxidation pathway shown in the lower portion of FIGS. 5-8. In some embodiments, beta-oxidation activities in the pathways shown in FIGS. 5-8 also can be engineered (e.g., as described herein) to enhance metabolism and target product formation. In some embodiments, one acyl-CoA oxidase activity of the beta-oxidation pathway is engineered to be enhanced, and in certain embodiments, the other acyl-CoA oxidase activity in the beta-oxidation pathway is altered to reduce or eliminate the activity, thereby optimizing the production of a diacid of a desired chain-length or diacids with a distribution of desired chain lengths. In some embodiments, an acyl-CoA oxidase is selected and/or engineered to alter the substrate specificity of the enzyme. In certain embodiments, the substrate specificity of a heterologous and/or engineered acyl-CoA oxidase is for carbon chain lengths of between about 12 carbons and about 18 carbons, and in some embodiments a heterologous and/or engineered acyl-CoA oxidase exhibits no activity on substrates below 12 carbons in length. In certain embodiments, a heterologous acyl-CoA oxidase with a desired chain length specificity can be isolated from any suitable organism. Non-limiting examples of organisms that include, or can be used as donors for acyl-CoA oxidase enzymes include yeast (e.g., *Candida, Saccharomyces, Debaryomyces, Meyerozyma, Lodderomyces, Scheffersomyces, Clavispora, Yarrowia, Pichia, Kluyveromyces, Eremothecium, Zygosaccharomyces, Lachancea, Nakaseomyces*), animals (e.g., *Homo, Rattus*), bacteria (e.g., *Escherichia, Pseudomonas, Bacillus*), or plants (e.g., *Arabidopsis, Nictotania, Cuphea*).

In certain embodiments, a carbon source starting material (e.g., alkane, fatty acid, fatty alcohol, dicarboxylic acid) of intermediate or long chain length (e.g., between about 10 carbons and 22 carbons) is converted into an acyl-CoA derivative for entry into the beta-oxidation pathway. The acyl-CoA derivative can be generated by the activity of an acyl-CoA ligase enzyme, in some embodiments. The acyl-CoA derivative is subsequently oxidized by the activity of an acyl-CoA oxidase enzyme (e.g., also known as acyl-CoA oxidoreductase and fatty acyl-coenzyme A oxidase) of natural or altered substrate specificity, in certain embodiments. The trans-2,3-dehydroacyl-CoA derivative long chain fatty alcohol, fatty acid or dicarboxylic acid may be further converted to 3-hydroxyacyl-CoA by the activity of enoyl-CoA hydratase. 3-hydroxyacyl-CoA can be converted to 3-oxoacyl-CoA by the activity of 3-hydroxyacyl-CoA dehydrogenase. 3-oxoacyl-CoA may be converted to an acyl-CoA molecule, shortened by 2 carbons and an acetyl-CoA, by the activity of Acetyl-CoA C-acyltransferase (e.g., also known as beta-ketothiolase and beta-ketothiolase). In some embodiments, acyl-CoA molecules may be repeatedly shortened by beta oxidation until a desired carbon chain length is generated (e.g., 10 or 12 carbons, sebacic acid or dodecanedioic acid, respectively). A shortened fatty acid can be further processed using omega oxidation to yield a dicarboxylic acid (e.g., dodecanedioic acid).

Beta-Oxidation Activities

The term "beta oxidation pathway" as used herein, refers to a series of enzymatic activities utilized to metabolize fatty alcohols, fatty acids, or dicarboxylic acids. The activities utilized to metabolize fatty alcohols, fatty acids, or dicarboxylic acids include, but are not limited to, acyl-CoA ligase activity, acyl-CoA oxidase activity, acyl-CoA hydrolase activity, acyl-CoA thioesterase activity, enoyl-CoA hydratase activity, 3-hydroxyacyl-CoA dehydrogenase activity and acetyl-CoA C-acyltransferase activity. The term "beta oxidation activity" refers to any of the activities in the beta oxidation pathway utilized to metabolize fatty alcohols, fatty acids or dicarboxylic acids.

Beta-Oxidation—Acyl-CoA Ligase

An acyl-CoA ligase enzyme sometimes is encoded by the host organism and can be added to generate an engineered organism. In some embodiments, host acyl-CoA ligase activity can be increased by increasing the number of copies of an acyl-CoA ligase gene, by increasing the activity of a promoter that regulates transcription of an acyl-CoA ligase gene, or by increasing the number copies of the gene and by increasing the activity of a promoter that regulates transcription of the gene, thereby increasing production of target product (e.g., sebacic or dodecanedioic acid) due to increased carbon flux through the pathway. In certain embodiments, the acyl-CoA ligase gene can be isolated from any suitable organism. Non-limiting examples of organisms that include, or can be used as donors for, acyl-CoA ligase enzymes include *Candida, Saccharomyces*, or *Yarrowia*.

Beta-Oxidation—Enoyl-CoA Hydratase

An enoyl-CoA hydratase enzyme catalyzes the addition of a hydroxyl group and a proton to the unsaturated β-carbon on a fatty-acyl CoA and sometimes is encoded by the host organism and sometimes can be added to generate an engineered organism. In certain embodiments, the enoyl-CoA hydratase activity is unchanged in a host or engineered organism. In some embodiments, the host enoyl-CoA hydratase activity can be increased by increasing the number of copies of an enoyl-CoA hydratase gene, by increasing the activity of a promoter that regulates transcription of an enoyl-CoA hydratase gene, or by increasing the number copies of the gene and by increasing the activity of a promoter that regulates transcription of the gene, thereby increasing the production of target product (e.g., sebacic or dodecanedioic acid) due to increased carbon flux through the pathway. In certain embodiments, the enoyl-CoA hydratase gene can be isolated from any suitable organism. Non-limiting examples of organisms that include, or can be used as donors for, enoyl-CoA hydratase enzymes include *Candida, Saccharomyces,* or *Yarrowia.*

Beta-Oxidation—3-Hydroxyacyl-CoA Dehydrogenase 3-hydroxyacyl-CoA dehydrogenase enzyme catalyzes the formation of a 3-ketoacyl-CoA by removal of a hydrogen from the newly formed hydroxyl group created by the activity of enoyl-CoA hydratase. In some embodiments, the activity is encoded by the host organism and sometimes can be added or increased to generate an engineered organism. In certain embodiments, the 3-hydroxyacyl-CoA activity is unchanged in a host or engineered organism. In some embodiments, the host 3-hydroxyacyl-CoA dehydrogenase activity can be increased by increasing the number of copies of a 3-hydroxyacyl-CoA dehydrogenase gene, by increasing the activity of a promoter that regulates transcription of a 3-hydroxyacyl-CoA dehydrogenase gene, or by increasing the number copies of the gene and by increasing the activity of a promoter that regulates transcription of the gene, thereby increasing production of target product (e.g., sebacic or dodecanedioic acid) due to increased carbon flux through the pathway. In certain embodiments, the 3-hydroxyacyl-CoA dehydrogenase gene can be isolated from any suitable organism. Non-limiting examples of organisms that include, or can be used as donors for, 3-hydroxyacyl-CoA dehydrogenase enzymes include *Candida, Saccharomyces,* or *Yarrowia.*

Beta-Oxidation—Acetyl-CoA C-Acyltransferase

An Acetyl-CoA C-acyltransferase (e.g., beta-ketothiolase) enzyme catalyzes the formation of a fatty acyl-CoA shortened by 2 carbons by cleavage of the 3-ketoacyl-CoA by the thiol group of another molecule of CoA. The thiol is inserted between C-2 and C-3, which yields an acetyl CoA molecule and an acyl CoA molecule that is two carbons shorter. An Acetyl-CoA C-acyltransferase sometimes is encoded by the host organism and sometimes can be added to generate an engineered organism. In certain embodiments, the acetyl-CoA C-acyltransferase activity is unchanged in a host or engineered organism. In some embodiments, the host acetyl-CoA C-acyltransferase activity can be increased by increasing the number of copies of an acetyl-CoA C-acyltransferase gene, or by increasing the activity of a promoter that regulates transcription of an acetyl-CoA C-acyltransferase gene, thereby increasing the production of target product (e.g., sebacic or dodecanedioic acid) due to increased carbon flux through the pathway. In certain embodiments, the acetyl-CoA C-acyltransferase gene can be isolated from any suitable organism. Non-limiting examples of organisms that include, or can be used as donors for, acetyl-CoA C-acyltransferase enzymes include *Candida, Saccharomyces,* or *Yarrowia.*

Omega Oxidation Activities

Targets for improving the productivity of diacid product formation from fatty acid feedstocks in β-oxidation blocked strains are often those which can improve carbon flux through the ω-oxidation pathway. In some embodiments, these targets are: 1) enzymes performing the rate-limiting step in the ω-oxidation pathway (e.g., CPR and CYP450), 2) enzymes performing fatty acid transport into the cell (e.g., Acyl CoA Synthetases), and 3) enzymes that provide the cofactors required for the ω-oxidation pathway (e.g., G6PDH).

The term "omega oxidation activity" refers to any of the activities in the omega oxidation pathway utilized to metabolize alkanes, fatty alcohols, fatty acids, dicarboxylic acids, or sugars. The activities utilized to metabolize fatty alcohols, fatty acids, or dicarboxylic acids include, but are not limited to, monooxygenase activity (e.g., cytochrome P450 activity), monooxygenase reductase activity (e.g., cytochrome P450 reductase activity), alcohol dehydrogenase activity (e.g., fatty alcohol dehydrogenase activity, or long-chain alcohol dehydrogenase activity), fatty alcohol oxidase activity, fatty aldehyde dehydrogenase activity, and thioesterase activity.

Omega Oxidation—Monooxygenases

A cytochrome P450 enzyme (e.g., monooxygenase activity) often catalyzes the insertion of one atom of oxygen into an organic substrate (RH) while the other oxygen atom is reduced to water. Insertion of the oxygen atom near the omega carbon of a substrate yields an alcohol derivative of the original starting substrate (e.g., yields a fatty alcohol). A cytochrome P450 sometimes is encoded by the host organism and sometimes can be added to generate an engineered organism.

In certain embodiments, the monooxygenase activity is unchanged in a host or engineered organism. In some embodiments, the host monooxygenase activity can be increased by increasing the number of copies of a cytochrome P450 gene, or by increasing the activity of a promoter that regulates transcription of a cytochrome P450 gene, thereby increasing the production of target product (e.g., sebacic or dodecanedioic acid) due to increased carbon flux through the pathway. In certain embodiments, the cytochrome P450 gene can be isolated from any suitable organism. Non-limiting examples of organisms that include, or can be used as donors for, cytochrome P450 enzymes include yeast (e.g., *Candida, Saccharomyces, Debaryomyces, Meyerozyma, Lodderomyces, Scheffersomyces, Clavispora, Yarrowia, Pichia, Kluyveromyces, Eremothecium, Zygosaccharomyces, Lachancea, Nakaseomyces*), animals (e.g., *Homo, Rattus*), bacteria (e.g., *Escherichia, Pseudomonas, Bacillus*), or plants (e.g., *Arabidopsis, Nictotania, Cuphea*).

The rate limiting step of ω-oxidation is the hydroxylation of the ω-carbon of a fatty acid which is carried out by an enzyme system composed of two enzymes, NADPH cytochrome P450 reductase (CPR) and cytochrome P450 monooxygenase (e.g., CYP52, EC 1.14.14.1). The P450's are a gene family that produces isozymes with different substrate specificities. In *Candida* the gene family is typically composed of CYP52A12, CYP52A13, CYP52A14, CYP52A15, CYP52A16, CYP52A17, CYP52A18, CYP52A19, CYP52A20, and CYP52D2. The P450 enzyme is encoded by a gene family of CYP genes designated A12-A20, and D2 in *Candida* spp. Each member of the P450 gene family displays unique substrate chain-length specificity. Using engineered *Candida* strains we have identified the P450 isozymes that improve performance upon different chain-length fatty acid feedstocks. For short- or medium-chain fatty acid feedstocks (C6-C14) CYP52A19 amplification improved performance more than the other isozymes. For long-chain fatty acid feedstocks (>C16) CYP52A14 amplification improved performance more than the other isozymes. In some embodiments, to increase the carbon flux through the ω-oxidation pathway the enzyme activity for one or both of the CPR and the P450 enzyme families is amplified. In some embodiments, care is taken to select the P450 family member with substrate specificity that matches the chain length of the exogenously supplied fatty acid feedstock. In some embodiments, to increase the carbon flux through the ω-oxidation pathway the enzyme activity of a CYP52A19 is amplified. In some embodiments, to increase the carbon flux through the ω-oxidation pathway the enzyme activity of a CYP52A14 is amplified.

The term "monooxygenase activity" as used herein refers to inserting one atom of oxygen from $O_2$ into an organic substrate (RH) and reducing the other oxygen atom to water. In some embodiments, monooxygenase activity refers to incorporation of an oxygen atom onto a six-carbon organic substrate. In certain embodiments, monooxygenase activity refers to conversion of hexanoate to 6-hydroxyhexanoic acid. Monooxygenase activity can be provided by any suitable polypeptide, such as a cytochrome P450 polypeptide (hereafter "CYP450") in certain embodiments. Nucleic acid sequences conferring CYP450 activity can be obtained from a number of sources, including Bacillus megaterium and may be induced in organisms including but not limited to Candida tropicalis, Yarrowia lipolytica, Aspergillus nidulans, and Aspergillus parasiticus. Examples of oligonucleotide sequences utilized to isolate a polynucleotide sequence encoding a polypeptide having CYP450 activity (e.g., CYP52A12 polynucleotide, a CYP52A13 polynucleotide, a CYP52A14 polynucleotide, a CYP52A15 polynucleotide, a CYP52A16 polynucleotide, a CYP52A17 polynucleotide, a CYP52A18 polynucleotide, a CYP52A19 polynucleotide, a CYP52A20 polynucleotide, a CYP52D2 polynucleotide, and/or a BM3 polynucleotide) are presented herein. In some embodiments, monooxygenase activity is not altered in a host microorganism, and in certain embodiments, the activity is added or increased in the engineered microorganism relative to the host microorganism. In some embodiments, the altered monooxygenase activity is an endogenous activity, and in certain embodiments, the altered monooxygenase activity is an exogenous activity. In some embodiments, the exogenous activity is a single polypeptide with both monooxygenase and monooxygenase reductase activities (e.g., B. megaterium cytochrome P450:NADPH P450 reductase).

Presence, absence or amount of cytochrome P450 activity can be detected by any suitable method known in the art. For example, detection can be performed by assaying a reaction containing cytochrome P450 (CYP52A family) and NADPH-cytochrome P450 reductase (see Appl Environ Microbiol 69: 5983 and 5992). Briefly, cells are grown under standard conditions and harvested for production of microsomes, which are used to detect CYP activity. Microsomes are prepared by lysing cells in Tris-buffered sucrose (10 mM Tris-HCl pH 7.5, 1 mM EDTA, 0.25M sucrose). Differential centrifugation is performed first at 25,000×g then at 100,000×g to pellet cell debris then microsomes, respectively. The microsome pellet is resuspended in 0.1M phosphate buffer (pH 7.5), 1 mM EDTA to a final concentration of approximately 10 mg protein/mL. A reaction mixture containing approximately 0.3 mg microsomes, 0.1 mM sodium hexanoate, 0.7 mM NADPH, 50 mM Tris-HCl pH 7.5 in 1 mL is initiated by the addition of NADPH and incubated at 37° C. for 10 minutes. The reaction is terminated by addition of 0.25 mL 5M HCl and 0.25 mL 2.5 ug/mL 10-hydroxydecanoic acid is added as an internal standard (3.3 nmol). The mixture is extracted with 4.5 mL diethyl ether under NaCl-saturated conditions. The organic phase is transferred to a new tube and evaporated to dryness. The residue is dissolved in acetonitrile containing 10 mM 3-bromomethyl-7-methoxy-1,4-benzoxazin-2-one (BrMB) and 0.1 mL of 15 mg/mL 18-crown-6 in acetonitrile saturated with $K_2CO_3$. The solution is incubated at 40° C. for 30 minutes before addition of 0.05 mL 2% acetic acid. The fluorescently labeled omega-hydroxy fatty acids are resolved via HPLC with detection at 430 nm and excitation at 355 nm (Yamada et al., 1991, Anal Biochem 199: 132-136). Optionally, specifically induced CYP gene(s) may be detected by Northern blotting and/or quantitative RT-PCR. (Craft et al., 2003, App Environ Micro 69: 5983-5991).

Omega Oxidation—Monooxygenase Reductases

A cytochrome P450 reductase (e.g., monooxygenase reductase activity) catalyzes the reduction of the heme-thiolate moiety in cytochrome P450 by transferring an electron to the cytochrome P450. A cytochrome P450 reductase sometimes is encoded by the host organism and sometimes can be added to generate an engineered organism. In certain embodiments, the monooxygenase reductase activity is unchanged in a host or engineered organism. In some embodiments, the host monooxygenase reductase activity can be increased by increasing the number of copies of a cytochrome P450 reductase gene, or by increasing the activity of a promoter that regulates transcription of a cytochrome P450 reductase gene, thereby increasing the production of target product (e.g., sebacic or dodecanedioic acid) due to increased carbon flux through the pathway. In certain embodiments, the cytochrome P450 reductase gene can be isolated from any suitable organism. Non-limiting examples of organisms that include, or can be used as donors for, cytochrome P450 reductase enzymes include yeast (e.g., Candida, Saccharomyces, Debaryomyces, Meyerozyma, Lodderomyces, Scheffersomyces, Clavispora, Yarrowia, Pichia, Kluyveromyces, Eremothecium, Zygosaccharomyces, Lachancea, Nakaseomyces), animals (e.g., Homo, Rattus), bacteria (e.g., Escherichia, Pseudomonas, Bacillus), or plants (e.g., Arabidopsis, Nictotania, Cuphea).

The reductase (CPR) enzyme (EC 1.6.2.4) is able to work with any of the P450 isozymes. The reductase is encoded by the genes CPRA and CPRB in Candida sp. In some embodiments, to increase the carbon flux through the ω-oxidation pathway the enzyme activity of a CPR is amplified. In some embodiments a CPRA gene is amplified. In some embodiments a CPRB gene is amplified.

The term "monooxygenase reductase activity" as used herein refers to the transfer of an electron from NAD(P)H, FMN, or FAD by way of an electron transfer chain, reducing the ferric heme iron of cytochrome P450 to the ferrous state. The term "monooxygenase reductase activity" as used herein also can refer to the transfer of a second electron via the electron transport system, reducing a dioxygen adduct to a negatively charged peroxo group. In some embodiments, a monooxygenase activity can donate electrons from the two-electron donor NAD(P)H to the heme of cytochrome P450 (e.g., monooxygenase activity) in a coupled two-step reaction in which NAD(P)H can bind to the NAD(P)H-binding domain of the polypeptide having the monooxygenase reductase activity and electrons are shuttled from NAD(P)H through FAD and FMN to the heme of the monooxygenase activity, thereby regenerating an active monooxygenase activity (e.g., cytochrome P450). Monooxygenase reductase activity can be provided by any suitable polypeptide, such as a cytochrome P450 reductase polypeptide (hereafter "CPR") in certain embodiments. Nucleic acid sequences conferring CPR activity can be obtained from and/or induced in a number of sources, including but not limited to Bacillus megaterium, Candida tropicalis, Yarrowia lipolytica, Aspergillus nidulans, and Aspergillus parasiticus. Examples of oligonucleotide sequences utilized to isolate a polynucleotide sequence encoding a polypeptide having CPR activity are presented herein. In some embodiments, monooxygenase reductase activity is not altered in a host microorganism, and in certain embodiments, the activity is added or increased in the engineered microorganism relative to the host microorganism. In some embodiments, the altered monooxygenase reductase activity is an endogenous activity, and in certain embodiments, the altered monooxygenase reductase activity is an exogenous activity. In some embodiments, the exogenous activity is a single polypeptide with both monooxygenase and monooxygenase reductase activities (e.g., *B. megaterium* cytochrome P450:NADPH P450 reductase).

Presence, absence or amount of CPR activity can be detected by any suitable method known in the art. For example, an engineered microorganism having an increased number of genes encoding a CPR activity, relative to the host microorganism, could be detected using quantitative nucleic acid detection methods (e.g., southern blotting, PCR, primer extension, the like and combinations thereof). An engineered microorganism having increased expression of genes encoding a CPR activity, relative to the host microorganism, could be detected using quantitative expression based analysis (e.g., RT-PCR, western blot analysis, northern blot analysis, the like and combinations thereof). Alternately, an enzymatic assay can be used to detect Cytochrome P450 reductase activity, where the enzyme activity alters the optical absorbance at 550 nanometers of a substrate solution (Masters, B. S. S., Williams, C. H., Kamin, H. (1967) Methods in Enzymology, X, 565-573).

Omega Oxidation—Hydroxy Fatty Acids

Omega-hydroxy fatty acids (HFAs) are intermediates in oxidation of the terminal methyl group of fatty acids (FIG. 31). HFAs can be produced during the first oxidation step in the omega-oxidation pathway, which is catalyzed by cytochrome P450 using molecular oxygen and electrons supplied by NADPH. Electron transfer from NADPH can be performed using the enzyme, cytochrome P450 reductase (CPR). HFAs can be further oxidized to form the omega-oxo-fatty acid. This oxidation of HFAs can occur through three different enzymatic mechanisms: 1) Over-oxidation by cytochrome P450 which requires molecular oxygen, NADPH, and CPR; 2) Alcohol dehydrogenase (ADH), which requires either NAD+ or NADP+, depending upon the specificity of the ADH; or 3) Fatty alcohol oxidase (FAO), which requires molecular oxygen and produces hydrogen peroxide as a byproduct in the reaction. FAO enzymes are membrane-bound and associated with peroxisomes in *Candida*. Omega-oxo-fatty acids can be oxidized to the dicarboxylic acid either through the over-oxidation reaction by cytochrome P450s or through the enzyme aldehyde dehydrogenase (ALD).

HFAs are frequently found in small, but economically significant amounts in dicarboxylic acid fermentations in which beta-oxidation-blocked strains of *Candida* using fatty acids or fatty acid methyl esters as feedstock. Although HFAs only constitute approximately 5-10% of the final oxidation product, the presence of HFAs can result in decreased yields and purity of a final fatty dicarboxylic acid product and can be undesirable.

Omega Oxidation—Alcohol Dehydrogenases

An alcohol dehydrogenase (e.g., fatty alcohol dehydrogenase, long-chain alcohol dehydrogenase) catalyzes the removal of a hydrogen from an alcohol to yield an aldehyde or ketone and a hydrogen atom and NADH, in the endoplasmic reticulum of a cell. In the case of longer chain alcohols (e.g., hexadecanol), water is utilized in the dehydrogenation to yield a long chain carboxylate, 2 NADH and $H_2$. An alcohol dehydrogenase sometimes is encoded by the host organism and sometimes can be added to generate an engineered organism. In certain embodiments, the alcohol dehydrogenase activity is unchanged in a host or engineered organism. In some embodiments, the host alcohol dehydrogenase activity can be increased by increasing the number of copies of an alcohol dehydrogenase gene, or by increasing the activity of a promoter that regulates transcription of an alcohol dehydrogenase gene, thereby increasing the production of target product (e.g., sebacic or dodecanedioic acid) due to increased carbon flux through the pathway. In certain embodiments, the alcohol dehydrogenase gene can be isolated from any suitable organism. Non-limiting examples of organisms that include, or can be used as donors for, alcohol dehydrogenase enzymes include yeast (e.g., *Candida, Saccharomyces, Debaryomyces, Meyerozyma, Lodderomyces, Scheffersomyces, Clavispora, Yarrowia, Pichia, Kluyveromyces, Eremothecium, Zygosaccharomyces, Lachancea, Nakaseomyces*), animals (e.g., *Homo, Rattus*), bacteria (e.g., *Escherichia, Pseudomonas, Bacillus*), or plants (e.g., *Arabidopsis, Nictotania, Cuphea*). Non-limiting examples of fatty alcohol dehydrogenases are ADH1, ADH2a, ADH2b, ADH3, ADH4, ADH6, ADH7, ADH8, SFA1, FAO1, EC 1.1.1.66, EC 1.1.1.164 and/or EC 1.1.1.192. In some embodiments, the expression of ADH1, ADH2a, ADH2b, ADH3, ADH4, ADH6, ADH7, ADH8, SFA1, FAO1, EC 1.1.1.66, EC 1.1.1.164 and/or EC 1.1.1.192 is increased in a fatty dicarboxylic acid producing organism.

Omega Oxidation—Fatty Alcohol Oxidases

A fatty alcohol oxidase (e.g., long-chain alcohol oxidase, EC 1.1.3.20) enzyme catalyzes the addition of oxygen to two molecules of a long-chain alcohol to yield 2 long chain aldehydes and 2 molecules of water, in the peroxisome of a cell. A fatty alcohol oxidase sometimes is encoded by the host organism and sometimes can be added to generate an engineered organism. In certain embodiments, the fatty alcohol oxidase activity is unchanged in a host or engineered organism. In some embodiments, the host fatty alcohol oxidase activity can be increased by increasing the number of copies of a fatty alcohol oxidase gene, or by increasing the activity of a promoter that regulates transcription of a fatty alcohol oxidase gene, thereby increasing the production of target product (e.g., sebacic or dodecanedioic acid) due to increased carbon flux through the pathway. In certain embodiments, the fatty alcohol oxidase gene can be isolated from any suitable organism. Non-limiting examples of fatty alcohol oxidases include FAO1, FAO2a, FAO2b, FAO13, FAO17, FAO18, FAO20 and FAO1ΔPTS1. Non-limiting examples of organisms that include, or can be used as donors for, fatty alcohol oxidase enzymes include yeast (e.g., *Candida, Saccharomyces, Debaryomyces, Meyerozyma, Lodderomyces, Scheffersomyces, Clavispora, Yarrowia, Pichia, Kluyveromyces, Eremothecium, Zygosaccharomyces, Lachancea, Nakaseomyces*), animals (e.g., *Homo, Rattus*), bacteria (e.g., *Escherichia, Pseudomonas, Bacillus*), or plants (e.g., *Arabidopsis, Nictotania, Cuphea*).

Omega Oxidation—Aldehyde Dehydrogenases

A fatty aldehyde dehydrogenase (e.g., long chain aldehyde dehydrogenase) enzyme catalyzes the oxidation of long chain aldehydes to a long chain dicarboxylic acid, NADH and $H_2$. A fatty aldehyde dehydrogenase sometimes is encoded by the host organism and sometimes can be added to generate an engineered organism. In certain embodiments, the fatty aldehyde dehydrogenase activity is unchanged in a host or engineered organism. In some embodiments, the host fatty aldehyde dehydrogenase activity can be increased by increasing the number of copies of a fatty aldehyde dehydrogenase gene, or by increasing the activity of a promoter that regulates transcription of a fatty aldehyde dehydrogenase gene, thereby increasing the production of target product (e.g., sebacic or dodecanedioic acid) due to increased carbon flux through the pathway. In certain embodiments, the fatty aldehyde dehydrogenase gene can be isolated from any suitable organism. Non-limiting examples of organisms that include, or can be used as donors for, fatty aldehyde dehydrogenase enzymes include yeast (e.g., *Candida, Saccharomyces, Debaryomyces, Meyerozyma, Lodderomyces, Scheffersomyces, Clavispora, Yarrowia, Pichia, Kluyveromyces, Eremothecium, Zygosaccharomyces, Lachancea, Nakaseomyces*), animals (e.g., *Homo, Rattus*), bacteria (e.g., *Escherichia, Pseudomonas, Bacillus*), or plants (e.g., *Arabidopsis, Nictotania, Cuphea*). Non-limiting examples of aldehyde dehydrogenases are ALD1, ALD5, HFD1, HFD1a, EC 1.2.1.3, EC 1.2.1.48 and/or HFD2. In some embodiments, the expression of ALD1, ALD5, HFD1 and/or HFD2 is increased in a fatty dicarboxylic acid producing organism.

Omega Oxidation—Thioesterases

A thioesterase enzyme (e.g., acyl-CoA thioesterase activity, acyl-ACP thioesterase activity) catalyzes the removal of Coenzyme A or acyl carrier protein (e.g., ACP) from a fatty acid including acyl-CoA or acyl carrier protein (e.g., esterified fatty acid) to yield a fatty acid and an alcohol. The reaction occurs in the presence of water and Coenzyme A or acyl carrier protein is specifically removed at a thiol group. A thioesterase sometimes is encoded by the host organism and sometimes can be added to generate an engineered organism. In certain embodiments, the thioesterase activity is unchanged in a host or engineered organism. In some embodiments, the host thioesterase activity can be increased by increasing the number of copies of a thioesterase gene, or by increasing the activity of a promoter that regulates transcription of a thioesterase gene, thereby increasing the production of target product (e.g., sebacic or dodecanedioic acid) due to increased carbon flux through the pathway. In certain embodiments, a thioesterase gene can be isolated from any suitable organism. Non-limiting examples of organisms that include, or can be used as donors for, thioesterase enzymes include yeast (e.g., *Candida, Saccharomyces, Debaryomyces, Meyerozyma, Lodderomyces, Scheffersomyces, Clavispora, Yarrowia, Pichia, Kluyveromyces, Eremothecium, Zygosaccharomyces, Lachancea, Nakaseomyces*), animals (e.g., *Homo, Rattus*), bacteria (e.g., *Escherichia, Pseudomonas, Bacillus*), or plants (e.g., *Arabidopsis, Nictotania, Cuphea*).

Transcription Factors

MIG1 ("Multicopy Inhibitor of GAL Gene Expression") is a transcription factor that primarily functions to repress the transcription of genes whose expression is turned off when glucose is present. Examples of such genes are enzymes involved in the utilization of sugars. When cells are glucose limited, MIG1 has been shown to be phosphorylated and removed from the nucleus such that it cannot repress transcription of its targeted genes. Without being limited by mechanism, it is believed that deletion of the MIG gene may increase activity in those genes involved in omega oxidation and transport required for the production of diacids. In some instances, deletion of one or both MIG1 alleles in microorganisms engineered to produce di-acids may serve to decrease the amount of omega-hydroxy fatty acids produced by the microorganism.

CTF1 is a putative zinc-finger transcriptional factor and is apparently similar to the *Aspergillus nidulans* FarA and FarB transcription factors. CTF1 is believed to activate genes required for fatty acid degradation that are induced by the presence of oleic acid. Overexpression of CTF1 is expected to increase expression of genes involved in omega and beta oxidation thereby increasing productivity of the engineered microorganisms.

UTR is a NADH kinase that phosphorylates both NAD and NADH into NADP and NADPH. The EC numbers for UTR 2.7.1.23. and 0.2.7.1.86, respectively. In the situation that there is an excess of NAD or NADH or a deficiency of NADP or NADPH, it can convert one into the other. During omega oxidation there may be an increase NADH but a decrease of NADPH. In some embodiments, overexpression of a NASH kinase increases production of a diacid.

Engineered Pathways

FIGS. 1-8 depict embodiments of biological pathways for making sebacic acid and dodecanedioic acid, using various alkanes, fatty acids, fatty alcohols or combinations thereof. Any suitable alkane, fatty acid, fatty alcohol, plant based oil, seed based oil, non-petroleum derived soap stock or the like can be used as the feedstock for the organism (e.g., dodecane, methyl laurate, lauric acid, carbon sources having 10 or greater carbons (e.g. for sebacic acid production) or carbon sources having 12 or greater carbons (e.g. for dodecanedioic acid production). In some embodiments, carbon sources with greater than 12 carbons can be metabolized using naturally occurring and/or engineered pathways to yield molecules that can be further metabolized using the beta oxidation pathway shown in the lower portion of FIGS. 5-8. In some embodiments, the activities in the pathways depicted in FIGS. 1-8 can be engineered, as described herein, to enhance metabolism and target product formation.

In certain embodiments, one or more activities in one or more metabolic pathways can be engineered to increase carbon flux through the engineered pathways to produce a desired product (e.g., sebacic or dodecanedioic acid). The engineered activities can be chosen to allow increased production of metabolic intermediates that can be utilized in one or more other engineered pathways to achieve increased production of a desired product with respect to the unmodified host organism. The engineered activities also can be chosen to allow decreased activity of enzymes that reduce production of a desired intermediate or end product (e.g., reverse activities). This "carbon flux management" can be optimized for any chosen feedstock, by engineering the appropriate activities in the appropriate pathways. Non-limiting examples are given herein using pure alkanes (e.g., single chain length alkanes, dodecane or example), mixed chain-length alkanes, long-chain alkanes, pure fatty acids (e.g., single chain length fatty acids, capric acid for example) and mixed chain length fatty acids (see FIGS. 1-8). The process of "carbon flux management" through engineered pathways produces a dicarboxylic acid (e.g. sebacic acid or dodecanedioic acid) at a level and rate closer to the calculated maximum theoretical yield for any given feedstock, in certain embodiments. The terms "theoretical yield" or "maximum theoretical yield" as used herein refer to the yield of product of a chemical or biological reaction that can be formed if the reaction went to completion. Theoretical yield is based on the stoichiometry of the reaction and ideal conditions in which starting material is completely consumed, undesired side reactions do not occur, the reverse reaction does not occur, and there no losses in the work-up procedure.

A microorganism may be modified and engineered to include or regulate one or more activities in a fatty dicarboxylic acid (e.g., octanedioic acid, decanedioic acid, dodecanedioic acid, tetradecanedioic acid, hexadecanedioic acid, octadecanedioic acid, eicosanedioic acid) pathway. The term "activity" as used herein refers to the functioning of a microorganism's natural or engineered biological pathways to yield various products including a fatty dicarboxylic acid (e.g., octanedioic acid, decanedioic acid, dodecanedioic acid, tetradecanedioic acid, hexadecanedioic acid, octadecanedioic acid, eicosanedioic acid) and its precursors. A fatty dicarboxylic acid (e.g., octanedioic acid, decanedioic acid, dodecanedioic acid, tetradecanedioic acid, hexadecanedioic acid, octadecanedioic acid, eicosanedioic acid) producing activity can be provided by any non-mammalian source in certain embodiments. Such sources include, without limitation, eukaryotes such as yeast and fungi and prokaryotes such as bacteria. In some embodiments, a reverse activity in a pathway described herein can be altered (e.g., disrupted, reduced) to increase carbon flux through a beta oxidation pathway, an omega oxidation pathway, or a beta oxidation and omega oxidation pathway, towards the production of target product (e.g., sebacic or dodecanedioic acid). In some embodiments, a genetic modification disrupts an activity in the beta oxidation pathway, or disrupts a polynucleotide that encodes a polypeptide that carries out a forward reaction in the beta oxidation pathway, which renders beta oxidation activity undetectable. The term "undetectable" as used herein refers to an amount of an analyte that is below the limits of detection, using detection methods or assays known (e.g., described herein). In certain embodiments, the genetic modification partially reduces beta oxidation activity. The term "partially reduces beta oxidation activity" as used here refers to a level of activity in an engineered organism that is lower than the level of activity found in the host or starting organism.

In some embodiments, a beta-oxidation activity can be modified to alter the catalytic specificity of the chosen activity. In certain embodiments, an acyl-CoA oxidase activity can be altered by modifying a catalytic domain associated with carbon chain length preference and/or specificity. In some embodiments, the altered catalytic specificity can be found by screening naturally occurring variant or mutant populations of a host organism. In certain embodiments, the altered catalytic can be generated by various mutagenesis techniques in conjunction with selection and/or screening for the desired activity. In some embodiments, the altered catalytic activity can be generated by generating chimeric acyl-CoA oxidases using a mix and match approach, followed by selection and/or screening for the desired catalytic activity. Examples of experiments performed to generate acyl-CoA oxidases with altered catalytic activity are described herein.

An activity within an engineered microorganism provided herein can include one or more (e.g., 1, 2, 3, 4, 5, 6, 7, 8, 9, 10, 11, 12, 13, 14 or all) of the following activities: 6-oxohexanoic acid dehydrogenase activity; 6-hydroxyhexanoic acid dehydrogenase activity; cytochrome P450 activity; cytochrome P450 reductase activity; fatty alcohol oxidase activity; acyl-CoA ligase activity, acyl-CoA oxidase activity; enoyl-CoA hydratase activity, 3-hydroxyacyl-CoA dehydrogenase activity, fatty acid synthase activity, lipase activity, acetyl-CoA carboxylase activity, acyltransferase activity (diacylglycerol acyl transferase, lecithin-cholesterol acyltransferase, phospholipid:diacylglycerol acyltransferase) and thioesterase activity (e.g., acyl-CoA hydrolase, acyl-CoA thioesterase, acyl-ACP thioesterase, acetyl-CoA C-acyltransferase, beta-ketothiolase, and the like). In certain embodiments, one or more (e.g., 1, 2, 3, 4, 5, 6, 7, 8, 9, 10 or all) of the foregoing activities is altered by way of a genetic modification. In some embodiments, one or more (e.g., 1, 2, 3, 4, 5, 6, 7, 8, 9, 10, 11, 12, 13, 14 or all) of the foregoing activities is altered by way of (i) adding a heterologous polynucleotide that encodes a polypeptide having the activity, and/or (ii) altering or adding a regulatory sequence that regulates the expression of a polypeptide having the activity. In certain embodiments, one or more of the foregoing activities is altered by way of (i) disrupting an endogenous polynucleotide that encodes a polypeptide having the activity (e.g., insertional mutagenesis), (ii) deleting a regulatory sequence that regulates the expression of a polypeptide having the activity, and/or (iii) deleting the coding sequence that encodes a polypeptide having the activity (e.g., knock out mutagenesis).

The term "omega hydroxyl fatty acid dehydrogenase activity" as used herein refers to conversion of an omega hydroxyl fatty acid to an omega oxo fatty acid. The omega hydroxyl fatty acid dehydrogenase activity can be provided by a polypeptide. In some embodiments, the polypeptide is encoded by a heterologous nucleotide sequence introduced to a host microorganism. In certain embodiments, an endogenous polypeptide having the omega hydroxyl fatty acid dehydrogenase activity is identified in the host microorganism, and the host microorganism is genetically altered to increase the amount of the polypeptide produced (e.g., a heterologous promoter is introduced in operable linkage with a polynucleotide that encodes the polypeptide; the copy number of a polynucleotide that encodes the polypeptide is increased (e.g., by introducing a plasmid that includes the polynucleotide)). Nucleic acid sequences conferring omega hydroxyl fatty acid dehydrogenase activity can be obtained from a number of sources, including *Actinobacter, Norcardia, Pseudomonas* and *Xanthobacter* bacteria. Examples of an amino acid sequence of a polypeptide having omega hydroxyl fatty acid dehydrogenase activity and a nucleotide sequence of a polynucleotide that encodes the polypeptide, are presented herein. Presence, absence or amount of omega hydroxyl fatty acid dehydrogenase activity can be detected by any suitable method known in the art. In some embodiments, omega hydroxyl fatty acid dehydrogenase activity is not altered in a host microorganism, and in certain embodiments, the activity is added or increased in the engineered microorganism relative to the host microorganism.

Increasing NADPH Production in Yeast Producing a Fatty Dicarboxylic Acid

The ω-oxidation pathway requires the cofactors NADPH in the first step and $NAD^+$ in the second and third steps. Since the first step in ω-oxidation is the rate-limiting step, amplification of the enzyme activity performing this step in the cell would also require a sufficient supply of the NADPH cofactor for the reaction. There are a number of cellular reactions that produce NADPH that may be used by the first step in ω-oxidation. Some of the enzymes performing NADPH-producing reactions in the cell are glucose-6-phosphate dehydrogenase, isocitrate dehydrogenase, and glycerol-3-phosphate dehydrogenase Amplification of the activity levels of any of these genes can increase cellular levels of NADPH to provide enough cofactor for an amplified ω-oxidation activity.

NADPH is required for both ω-oxidation and fatty acid synthesis. Genetic changes that increase the amount of NADPH in the cell can result in a production boost for the production of diacid from either single fatty acids and/or fatty acids mixtures. In addition, if the number of NADPH obtained per glucose is increased, the amount of glucose required as co-feed can be reduced.

Increasing NADPH Production by Increasing Glucose-6-Phosphate Dehydrogenase Activity Through Overexpression of ZWF1 or ZWF2 Genes The ZWF1 and ZWF2 genes encode two isozymes of glucose-6-phosphate dehydrogenase (G6PDH, e.g., EC 1.1.1.49). In *S. cerevisiae* increasing glucose-6-phosphate dehydrogenase (G6PDH) activity results in an increase in cytosolic NADPH. This technique has been used to create strains with increased xylitol production and increased furfurals resistance. In some embodiments the ZWF1 open reading frame will be amplified from either *Candida* strain ATCC20336 or *Scheffersomyces stipitis* and placed under the control of the ZWF1 promoter, TEF1 promoter, POX4 promoter, or another strong constitutive or inducible promoter. These cassettes can be transformed into suitable yeast strains for either specific or random integration using the URA3 auxotrophic marker for selection. Ura+ strains can be analyzed by PCR and qPCR for proper integration or copy number. Increased glucose-6-phosphate dehydrogenase activity can be confirmed by activity assays. Strains can then be tested for production of the desired fatty dicarboxylic acid. In some embodiments strains can then be tested for production of a octanedioic acid, decanedioic acid, dodecanedioic acid, tetradecanedioic acid, hexadecanedioic acid, octadecanedioic acid, eicosanedioic acid, suberic or adipic acid depending on the strain and feedstock used. The fermentation performance of a yeast strain engineered for increased NADPH production can be compared to the parental strain.

Two examples of the amino acid sequences for G6PDH are shown below:
>*Scheffersomyces_stipitis*_ZWF1—SEQ ID NO: 157
*Candida* strain ATCC20336_ZWF1—SEQ ID NO: 74

Increasing NADPH production by decreasing glycolysis and increasing pentose pathway through disruption of the PGI1 gene.

In some embodiments a disruption cassette for PGI1 is constructed. For example 300 to 700 bp of the 5' and 3' untranslated region or open reading frame of the PGI1 gene can be amplified. The two pieces can be ligated together leaving a unique restriction site between them where an URA3 can be cloned into. This URA3 cassette can have either the terminator or promoter duplicated in either the beginning or the end of the URA3 cassette, respectively. The direct repeat can allow loop-out of the URA3. The disruption cassette can then be transformed into a suitable yeast strain and select by growing in uracil deficient plates. Disruption of the first copy of PGI1 can be verified by PCR. URA3 loopout events can be selected by growth in 5-Fluorootic acid containing plates. The loop-out event can be verified by PCR using primers outside the region encompassing the transformation cassette. This strain can be transformed with the PGI1 disruption cassette previously used or a new disruption cassette that targets regions not present in the first disruption. Ura+ strains can be screened for the complete loss of the PGI1 gene. Strains can then be tested for production of the desired fatty dicarboxylic acid. In some embodiments strains can then be tested for production of an octanedioic acid, decanedioic acid, dodecanedioic acid, tetradecanedioic acid, hexadecanedioic acid, octadecanedioic acid, eicosanedioic acid, suberic or adipic acid depending on the strain and feedstock used. The fermentation performance of a yeast strain engineered for increased NADPH production can be compared to the parental strain.

An example of the amino acid sequences for PGI1 is shown below:

*Candida* strain ATCC20336_PGI1—SEQ ID NO: 78

Increasing NADPH Production by Overexpression of KlGDP1

GDP1 (e.g., GDP1 of *Kluyveromyces lactis*, i.e., KlGDP1) encodes an NADP+ depending glyceraldehyde dehydrogenase (EC 1.2.1.9) that converts glyceraldehyde 3-phosphate into 1,3 biphosphoglycerate producing NADPH instead of NADH. This activity can increase the production of NADPH from glucose. KlGDP1 open reading can be mutagenized to change the CTG codon to another leucine encoding codon. The open reading frame can be placed under the control of the TEF1 promoter, POX4 promoter or another strong constitutive or inducible promoter. These cassettes can be integrated into any suitable yeast strain by targeted or random integration using the URA3 auxotrophic marker to select for transformation events. Ura+ strains can be analyzed by PCR and qPCR for proper integration or copy number determination. In addition, increased NADP+ dependent glyceraldehyde 3-phosphate dehydrogenase activity can be confirmed by activity assay. Strains can then be tested for production of the desired fatty dicarboxylic acid. In some embodiments strains can then be tested for production of an octanedioic acid, decanedioic acid, dodecanedioic acid, tetradecanedioic acid, hexadecanedioic acid, octadecanedioic acid, eicosanedioic acid, suberic or adipic acid depending on the strain and feedstock used. The fermentation performance of a yeast strain engineered for increased NADPH production can be compared to the parental strain.

An example of the amino acid sequence for GDP1 is shown below:
>GDP1, Kl—SEQ ID NO: 72

Increasing NADPH Production by Overexpression of IDPs

IDP1 and IDP2 (e.g., from *Candida* strain 20336) encode proteins with an isocitrate dehydrogenase activity that converts isocitrate to α-ketoglutarate producing NADPH instead of NADH (e.g., EC 1.1.1.42). The IDP1 protein is targeted to the mitochondria while the IDP2 protein is targeted to the peroxisome and it can be present in the ER where ω-oxidation happens. IDP2 expression has been shown to be induced by the presence of alkanes and overexpression may increase NADPH availability.

The open reading frame can be placed under the TEF1 promoter, POX4 promoter, or another strong constitutive or inducible promoter. These cassettes can be integrated into any suitable yeast strains either by targeted integration or random integration using the URA3 auxotrophic marker to select for transformation events. Ura+ strains can be verified by PCR and qPCR for proper integration or copy number. In addition, increased NADP+ dependent isocitrate dehydrogenase activity can be confirmed by activity assay. Strains can then be tested for production of the desired fatty dicarboxylic acid. In some embodiments strains can then be tested for production of an octanedioic acid, decanedioic acid, dodecanedioic acid, tetradecanedioic acid, hexadecanedioic acid, octadecanedioic acid, eicosanedioic acid, suberic or adipic acid depending on the strain and feedstock used. The fermentation performance of a yeast strain engineered for increased NADPH production can be compared to the parental strain.

Another IDP to be tested can be IDP3 (e.g. from *Saccharomyces cerevisiae*, i.e., ScIdp3). This protein is targeted to the peroxisome and may also be present in the ER. A similar approach can be taken for IDP2 except that the open reading frame may need to be mutagenized if there are any CTG codons.

An example of the amino acid sequences for an IDP2 and IDP3 are shown below:
  Candida strain ATCC20336_IDP2—SEQ ID NO: 67
  >Saccharomyces_cerevisiae_IDP3—SEQ ID NO: 69
  Increasing NADPH Production by Overexpression of ScMAE1 and ScPYC2

MAE encodes a malic enzyme (e.g., 1.1.1.40) converting malic acid to pyruvate producing NADPH (as shown below).

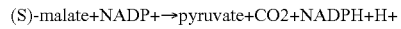
(S)-malate+NADP+→pyruvate+CO2+NADPH+H+

When overexpressed in the cytosol in the presence of PYC2 (i.e., pyruvate carboxylase, e.g., 6.4.1.1) that converts pyruvate to oxaloacetate) a shunt is formed that produces one NADPH at the expense of one ATP and NADH. MAE expression can be directed to the cytosol by expressing a truncated version that prevents its translocation into the mitochondria.

MAE1 (e.g., from a Candida strain or Saccharomyces cerevisiae, i.e., ScMAE1) and PYC2 (e.g., from Saccharomyces cerevisiae, i.e., ScPYC2) open reading frames can be amplified and mutagenized to replace any CTG codons for other leucine encoding codons. The genes can be placed under the control of the TEF1 promoter, POX4 promoter, or another strong constitutive or inducible promoter. These cassettes can be integrated into any suitable yeast strain by targeting integration or random integration using the URA3 auxotrophic marker to select for transformation events. Ura+ strains can be verified by PCR and qPCR for proper integration or copy number. Strains can then be tested for production of the desired fatty dicarboxylic acid. In some embodiments strains can then be tested for production of an octanedioic acid, decanedioic acid, dodecanedioic acid, tetradecanedioic acid, hexadecanedioic acid, octadecanedioic acid, eicosanedioic acid, suberic or adipic acid depending on the strain and feedstock used. The fermentation performance of a yeast strain engineered for increased NADPH production can be compared to the parental strain.

An example of the amino acid sequences for a ScMAE1 and ScPYC2 are shown below:
  >ScMAE1—SEQ ID NO: 191
  >ScPYC2—SEQ ID NO: 107
  >Candida strain, truncated cytosolic MAE1—SEQ: ID 143

Increasing NADPH Production when Using Glycerol as a Co-Feed

Archaeoglobus fulgidus gpsA encodes a glycerol 3-phosphate dehydrogenase using NADP+ as a co-factor. The gene encoding this enzyme can be mutagenized to change any CTG codons to other leucine encoding codons. This gene can be placed under either a constitutive or glycerol inducible promoter with a loop-out capable URA3 auxotrophic marker in a disruption cassette for GUT2. This cassette can be transformed into any suitable yeast strain disrupting the first copy of GUT2. The URA3 marker can be recycled and the resulting strain can be retransformed with the integration cassette. Strains that have both copies of GUT2 disrupted can be selected. This strain should produce NADPH instead of FADH in the conversion of glycerol-3-phosphate to dihydroxyacetone. Strains can then be tested for production of the desired fatty dicarboxylic acid. In some embodiments strains can then be tested for production of an octanedioic acid, decanedioic acid, dodecanedioic acid, tetradecanedioic acid, hexadecanedioic acid, octadecanedioic acid, eicosanedioic acid, suberic or adipic acid depending on the strain and feedstock used. The fermentation performance of a yeast strain engineered for increased NADPH production can be compared to the parental strain.

An example of the amino acid sequences for a GUT2 and Archaeoglobus fulgidus gpsA are shown below:
  >Candida strain ATCC20336 GUT2—SEQ ID NO: 109
  >AfgpsA—SEQ ID NO: 111

Acyl-CoA Oxidases

The term "acyl-CoA oxidase activity" as used herein refers to the oxidation of a long chain fatty-acyl-CoA to a trans-2,3-dehydroacyl-CoA fatty alcohol. In some embodiments, the acyl-CoA activity is from a peroxisome. In certain embodiments, the acyl-CoA oxidase activity is a peroxisomal acyl-CoA oxidase (POX) activity, carried out by a POX polypeptide. In some embodiments the acyl-CoA oxidase activity is encoded by the host organism and sometimes can be altered to generate an engineered organism. Acyl-CoA oxidase activity is encoded by the POX4 and POX5 genes of C. tropicalis. In certain embodiments, endogenous acyl-CoA oxidase activity can be increased. In some embodiments, acyl-CoA oxidase activity of the POX4 polypeptide or the POX5 polypeptide can be altered independently of each other (e.g., increase activity of POX4 alone, POX5 alone, increase one and disrupt the other, and the like). Increasing the activity of one POX activity, while disrupting the activity of another POX activity, may alter the specific activity of acyl-CoA oxidase with respect to carbon chain length, while maintaining or increasing overall flux through the beta oxidation pathway, in certain embodiments.

In certain embodiments, host acyl-CoA oxidase activity of one of the POX genes can be increased by genetically altering (e.g., increasing) the amount of the polypeptide produced (e.g., a strongly transcribed or constitutively expressed heterologous promoter is introduced in operable linkage with a polynucleotide that encodes the polypeptide; the copy number of a polynucleotide that encodes the polypeptide is increased (e.g., by introducing a plasmid that includes the polynucleotide, integration of additional copies in the host genome)). In some embodiments, the host acyl-CoA oxidase activity can be decreased by disruption (e.g., knockout, insertion mutagenesis, the like and combinations thereof) of an acyl-CoA oxidase gene, or by decreasing the activity of the promoter (e.g., addition of repressor sequences to the promoter or 5'UTR) which transcribes an acyl-CoA oxidase gene.

As noted above, disruption of nucleotide sequences encoding POX4, POX 5, or POX4 and POX5 sometimes can alter pathway efficiency, specificity and/or specific activity with respect to metabolism of carbon chains of different lengths (e.g., carbon chains including fatty alcohols, fatty acids, paraffins, dicarboxylic acids of between about 1 and about 60 carbons in length). In some embodiments, the nucleotide sequence of POX4, POX5, or POX4 and POX5 is disrupted with a URA3 nucleotide sequence encoding a selectable marker, and introduced to a host microorganism, thereby generating an engineered organism deficient in POX4, POX5 or POX4 and POX5 activity. Nucleic acid sequences encoding POX4 and POX5 can be obtained from a number of sources, including Candida tropicalis, for example. Examples of POX4 and POX5 amino acid sequences and nucleotide sequences of polynucleotides that encode the polypeptides, are presented herein. Described in the examples are experiments conducted to amplify the activity encoded by the POX5 gene.

Also as noted above, catalytic specificity of acyl-CoA oxidases (e.g., POX4, POX5) can be altered by a variety of methods. Altering the binding and/or catalytic specificity of acyl-CoA oxidases may prove advantageous for generating novel acyl-CoA oxidases with altered chain length recognition, altered chain length catalytic activity, and/or generation of an acyl-CoA oxidase activity with a narrow or specific chain length specificity, thereby allowing further increases in pathway efficiency, specificity and/or specific activity with respect to metabolism of carbon chains of different lengths or metabolism of carbon chain distributions found in a particular chosen feedstock. In some embodiments the altered acyl-CoA oxidase sequences are identified and/or generated by; (i) screening naturally occurring variant populations; (ii) mutagenesis of endogenous sequences; (iii) introduction of heterologous sequences having a desired specificity; (iv) generation of chimeric sequences having a portion of the coding sequence from one polynucleotide source (e.g., gene, organism) and a portion of the coding sequence from another source and/or (v) intelligent design using nucleotide sequences and three dimensional structure analysis from an acyl-CoA oxidase having a desired specificity to remodel an endogenous acyl-CoA oxidase, thereby generating a novel specificity enzyme. In some embodiments a chimeric acyl-CoA oxidase sequence can have polynucleotide sequence contributions from two or more sources. In some embodiments, a chimeric acyl-CoA oxidase sequence comprises a portion of the coding sequences from an endogenous polynucleotide and a portion of the coding sequence from a heterologous polynucleotide. Described in the examples are methods utilized to identify and/or generate acyl-CoA oxidases with novel catalytic and binding specificities.

Presence, absence or amount of POX4 and/or POX5 activity can be detected by any suitable method known in the art. For example, using enzymatic assays as described in Shimizu et al, 1979, and as described herein in the Examples. Alternatively, nucleic acid sequences representing native and/or disrupted POX4 and POX5 sequences also can be detected using nucleic acid detection methods (e.g., PCR, primer extension, nucleic acid hybridization, the like and combinations thereof), or quantitative expression based analysis (e.g., RT-PCR, western blot analysis, northern blot analysis, the like and combinations thereof), where the engineered organism exhibits decreased RNA and/or polypeptide levels as compared to the host organism.

Thioesterase

The term "thioesterase activity" as used herein refers to removal of Coenzyme A from hexanoate. The term "thioesterase activity" as used herein also refers to the removal of Coenzyme A from an activated fatty acid (e.g., fatty-acyl-CoA). A Non-limiting example of an enzyme with thioesterase activity includes acyl-CoA hydrolase (e.g., EC 3.1.2.20; also referred to as acyl coenzyme A thioesterase, acyl-CoA thioesterase, acyl coenzyme A hydrolase, thioesterase B, thioesterase II, lecithinase B, lysophopholipase L1, acyl-CoA thioesterase 1, and acyl-CoA thioesterase). Thioesterases that remove Coenzyme A from fatty-acyl-CoA molecules catalyze the reaction,

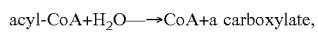

acyl-CoA+H$_2$O—→CoA+a carboxylate, where the carboxylate often is a fatty acid. The released Coenzyme A can then be reused for other cellular activities.

The thioesterase activity can be provided by a polypeptide. In certain embodiments, the polypeptide is an endogenous nucleotide sequence that is increased in copy number, operably linked to a heterologous and/or endogenous promoter, or increased in copy number and operably linked to a heterologous and/or endogenous promoter. In some embodiments, the polypeptide is encoded by a heterologous nucleotide sequence introduced to a host microorganism.

Nucleic acid sequences conferring thioesterase activity can be obtained from a number of sources, including *Cuphea lanceolata, C. tropicalis* (e.g., see SEQ ID NOS: 33 and 35), and *E. coli* (e.g., see SEQ ID NO: 37). Additional organisms that can be used as thioesterase polynucleotide sequence donors are given herein. Examples of such polypeptides include, without limitation, acyl-(ACP) thioesterase type B from *Cuphea lanceolata* (see SEQ ID NO: 1), acyl-CoA hydrolase (e.g., ACHA and ACHB, see SEQ ID NOS: 34 and 36)) from *C. tropicalis*, acyl-CoA thioesterase (e.g., TESA, see SEQ ID NO: 38) from *E. coli*. A non-limiting example of a thioesterase polynucleotide sequences is referenced by accession number CAB60830 at the National Center for Biotechnology Information (NCBI).

Presence, absence or amount of thioesterase activity can be detected by any suitable method known in the art. An example of such a method is described Chemistry and Biology 9: 981-988. In some embodiments, thioesterase activity is not altered in a host microorganism, and in certain embodiments, the activity is added or increased in the engineered microorganism relative to the host microorganism. In some embodiments, a polypeptide having thioesterase activity is linked to another polypeptide (e.g., a hexanoate synthase A or hexanoate synthase B polypeptide). Non-limiting examples of polynucleotide sequences encoding thioesterase activities and polypeptides having thioesterase activity are provided in Example 33.

Reducing Omega Fatty Acid Conversion—General

The term "a genetic modification that reduces omega hydroxyl fatty acid conversion" as used herein refer to genetic alterations of a host microorganism that reduce an endogenous activity that converts an omega hydroxyl fatty acid to another product. In some embodiments, an endogenous omega hydroxyl fatty acid dehydrogenase activity is reduced. Such alterations can advantageously increase the amount of a dicarboxylic acid, which can be purified and further processed.

Reducing Beta Oxidation—General

The term "a genetic modification that reduces beta-oxidation activity" as used herein refers to a genetic alteration of a host microorganism that reduces an endogenous activity that oxidizes a beta carbon of carboxylic acid containing organic molecules. In certain embodiments, the organic molecule is a ten or twelve carbon molecule, and sometimes contains one or two carboxylic acid moieties located at a terminus of the molecule (e.g., sebacic or dodecanedioic acid). Such alterations can advantageously increase yields of end products, such as a fatty dicarboxylic acid (e.g., octanedioic acid, decanedioic acid, dodecanedioic acid, tetradecanedioic acid, hexadecanedioic acid, octadecanedioic acid, eicosanedioic acid).

The term "a genetic modification that results in increased fatty acid synthesis" as used herein also refers to a genetic alteration of a host microorganism that reduces an endogenous activity that converts fatty acids into fatty-acyl-CoA intermediates. In some embodiments, an endogenous activity that converts fatty acids into fatty-acyl-CoA intermediates is reduced. In certain embodiments, an acyl-CoA synthetase activity is reduced. Such alterations can advantageously increase yields of end products, such as a fatty dicarboxylic acid (e.g., octanedioic acid, decanedioic acid, dodecanedioic acid, tetradecanedioic acid, hexadecanedioic acid, octadecanedioic acid, eicosanedioic acid).

Acyl-CoA Synthetase

Organisms that have a complete block of the β-oxidation pathway cannot utilize fatty acids or diacids for energy. In these β-oxidation blocked organisms, the chain length of the diacid produced mimics the chain length of the fatty acid feedstock. Blocking the β-oxidation pathway removes the primary route for diacid product yield loss. In some embodiments, genetic modifications that alter the cell's ability to utilize fatty acids in other biochemical pathways results in increased diacid production. In some embodiments, blocking a fatty acid activation pathway by knocking out or modifying an acyl CoA synthetase results in increased diacid production.

The activation of fatty acids to fatty acyl-CoA thioesters is performed by an enzyme called acyl-CoA synthetase (ACS). Acyl-CoA synthetases are a member of the ligase class of enzymes and catalyzes the reaction,

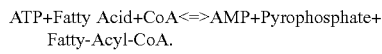

Fatty acids can be converted into fatty-acyl-CoA intermediates by the activity of an acyl-CoA synthetase (e.g., ACS1, ACS2; EC 6.2.1.3; also referred to as acyl-CoA synthetase, acyl-CoA ligase), in many organisms. Yeast cells contain multiple genes for ACS enzymes that are targeted to different cellular locations and may have different substrate chain-length specificities. *S. cerevisiae* has six genes with ACS activity named FAA1, FAA2. FAA3, FAA4, FAT1, and FAT2. The corresponding proteins produced by these genes are often called Faa1p, Faa2p, Faa3p, Faa4p, Fat1p and Fat2p respectively. The Faa1p isozyme can exhibit broad substrate chain-length specificity, represents 90% of the cellular ACS activity, and is localized in the cytosolic and microsomal fractions. The Faa2p isozyme is targeted to the peroxisome and has broad chain-length specificity. The Faa3p isozyme has a substrate specificity for long-chain or very long-chain fatty acids and its cellular localization is unknown. Faa4p has broad chain-length specificity and has been shown to be important in protein myristoylation. Fat1p is a dual function protein localized to the cellular membrane that has activity for both fatty acid transport and fatty acid activation. Fat2p is targeted to the peroxisomal membrane for medium chain fatty acid transport and activation.

Acyl-CoA synthetase has six isoforms encoded by ACS1, FAT1, ACS2A, ACS2B, ACS2C, and ACS2D, respectively, in some *Candida* spp. (e.g., homologous to FAA1, FAT1, and FAA2 in *S. cerevisiae*).

Disruption of the genes encoding ACS isozymes with activity targeted to the cellular membrane and to the cytosolic fraction can leave the exogenously supplied fatty acids in the free fatty acid form which is a substrate for entry into the w-oxidation pathway. This essentially redirects exogenously supplied fatty acids from normal cellular utilization (energy, triacylglycerides, phospholipids) to the production of the desired diacid product. In some embodiments, in *Candida* strain ATCC20336 these gene targets are ACS1 and FAT1.

*Candida* strain ATCC20336_ACS1—SEQ ID NO: 40
*Candida* strain ATCC20336_FAT1—SEQ ID NO: 148

Disruption of the genes encoding ACS isozymes with activity targeted to the peroxisome can prevent the activation of any exogenously supplied fatty acids that are transported to the interior of the peroxisomal compartment. In a β-oxidation blocked organism fatty acyl-CoA molecules cannot enter β-oxidation, but they can be substrates for the synthesis of phospholipids. Knocking out the genes encoding these ACS isozymes can increase the yield of a diacid product by redirecting the free fatty acids to ω-oxidation instead of the phospholipid synthesis pathway. *Candida* strain ATCC20336 homologs to the peroxisomal *S. cerevi-*

*siae* FAA2 are named ACS2A, ACS2B, ACS2C, and ACS2D and the protein sequences of ACS2A, ACS2B and ACS2C are shown below.

*Candida* strain ATCC20336_ACS2A—SEQ ID NO: 80
*Candida* strain ATCC20336_ACS2B—SEQ ID NO: 158
*Candida* strain ATCC20336_ACS2C—SEQ ID NO: 159

Fatty acids and Coenzyme A often are utilized in the activation of fatty acids to fatty-acyl-CoA intermediates for entry into various cellular processes. Without being limited by theory, it is believed that reduction in the amount of fatty-acyl-CoA available for various cellular processes can increase the amount of fatty acids available for conversion into a fatty dicarboxylic acid (e.g., octanedioic acid, decanedioic acid, dodecanedioic acid, tetradecanedioic acid, hexadecanedioic acid, octadecanedioic acid, eicosanedioic acid) by other engineered pathways in the same host organism (e.g., omega oxidation pathway, beta oxidation pathway, omega oxidation pathway and beta oxidation pathway). Acyl-CoA synthetase can be inactivated by any suitable means. Described herein are gene knockout methods suitable for use to disrupt the nucleotide sequence that encodes a polypeptide having ACS1 activity. A nucleotide sequence of ACS1 is provided in Example 33, SEQ ID NO: 39. An example of an integration/disruption construct, configured to generate a deletion mutant for ACS1 is also provided in the Examples.

The presence, absence or amount of acyl-CoA synthetase activity can be detected by any suitable method known in the art. Non-limiting examples of suitable detection methods include enzymatic assays (e.g., Lageweg et al "A Fluorimetric Assay for Acyl-CoA Synthetase Activity", Analytical Biochemistry, 197(2):384-388 (1991)), PCR based assays (e.g., qPCR, RT-PCR), immunological detection methods (e.g., antibodies specific for acyl-CoA synthetase), the like and combinations thereof.

The term "a genetic modification that results in increased fatty acid synthesis" as used herein also refers to a genetic alteration of a host microorganism that reduces an endogenous activity that converts long chain and very long chain fatty acids into activated fatty-acyl-CoA intermediates. In some embodiments, an endogenous activity that converts long chain and very long chain fatty acids into activated fatty-acyl-CoA intermediates is reduced. In certain embodiments, a long chain acyl-CoA synthetase activity is reduced. Such alterations can advantageously increase yields of end products, such as a fatty dicarboxylic acid (e.g., octanedioic acid, decanedioic acid, dodecanedioic acid, tetradecanedioic acid, hexadecanedioic acid, octadecanedioic acid, eicosanedioic acid).

Long chain fatty acids (e.g., C12-C18 chain lengths) and very long chain fatty acids (e.g., C20-C26) often are activated and/or transported by the thioesterification activity of a long-chain acyl-CoA synthetase (e.g., FAT1; EC 6.2.1.3; also referred to as long-chain fatty acid-CoA ligase, acyl-CoA synthetase; fatty acid thiokinase (long chain); acyl-activating enzyme; palmitoyl-CoA synthase; lignoceroyl-CoA synthase; arachidonyl-CoA synthetase; acyl coenzyme A synthetase; acyl-CoA ligase; palmitoyl coenzyme A synthetase; thiokinase; palmitoyl-CoA ligase; acyl-coenzyme A ligase; fatty acid CoA ligase; long-chain fatty acyl coenzyme A synthetase; oleoyl-CoA synthetase; stearoyl-CoA synthetase; long chain fatty acyl-CoA synthetase; long-chain acyl CoA synthetase; fatty acid elongase (ELO); LCFA synthetase; pristanoyl-CoA synthetase; ACS3; long-chain acyl-CoA synthetase I; long-chain acyl-CoA synthetase II; fatty acyl-coenzyme A synthetase; long-chain acyl-coenzyme A synthetase; and acid:CoA ligase (AMP-forming)), in some organisms. Fatty acids also can be transported into the host organism from feedstocks by the activity of long chain acyl-CoA synthetase.

Long-chain acyl-CoA synthetase catalyzes the reaction,

ATP+a long-chain carboxylic acid+CoA=AMP+ diphosphate+an acyl-CoA, where "an acyl-CoA" refers to a fatty-acyl-CoA molecule. As noted herein, activation of fatty acids is often necessary for entry of fatty acids into various cellular processes (e.g., as an energy source, as a component for membrane formation and/or remodeling, as carbon storage molecules). Deletion mutants of FAT1 have been shown to accumulate very long chain fatty acids and exhibit decreased activation of these fatty acids. Without being limited by theory, it is believed that reduction in the activity of long-chain acyl-CoA synthetase may reduce the amount of long chain fatty acids converted into fatty-acyl-CoA intermediates, thereby increasing the amount of fatty acids available for conversion into a fatty dicarboxylic acid (e.g., octanedioic acid, decanedioic acid, dodecanedioic acid, tetradecanedioic acid, hexadecanedioic acid, octadecanedioic acid, eicosanedioic acid) by other engineered pathways in the same host organism (e.g., omega oxidation pathway, beta oxidation pathway, omega oxidation pathway and beta oxidation pathway). Long-chain-acyl-CoA synthetase activity can be reduced or inactivated by any suitable means. Described herein are gene knockout methods suitable for disrupting the nucleotide sequence that encodes the polypeptide having FAT1 activity. The nucleotide sequence of FAT1 is provided in Example 33, SEQ ID NO: 41. DNA vectors suitable for use in constructing "knockout" constructs are described herein.

The presence, absence or amount of long-chain-acyl-CoA synthetase activity can be detected by any suitable method known in the art. Non-limiting examples of suitable detection methods include enzymatic assays, binding assays (e.g., Erland et al, Analytical Biochemistry 295(1):38-44 (2001)), PCR based assays (e.g., qPCR, RTPCR), immunological detection methods (e.g., antibodies specific for long-chain-acyl-CoA synthetase), the like and combinations thereof.

Selective Modification of Fat1p to Retain Transport Activity

Transport of free fatty acids across a cellular membrane can occur by passive diffusion or by protein-mediated active transport. The mechanism of passive diffusion can be manipulated (increased rate or decreased rate) to some extent, by the choice of fatty acid feedstock or by changing the extracellular environment. The rate of active transport of free fatty acids into the cell may be increased by amplifying transport proteins involved in fatty acid import. One such enzyme is Fat1p (e.g., Fat1p of *S. cerevisiae*) which is a dual function protein with both fatty acid transport and acyl-CoA synthetase activities.

Discussed above were the benefits of knocking out enzymes with acyl-CoA synthetase activity. In order to increase fatty acid transport into the cell without also increasing ACS activity, mutants of the Fat1p can be constructed that are transport competent but ACS incompetent.

Fat1p can transport a free fatty acid across a cellular membrane and "activate" the fatty acid to an acyl-CoA thioester on the inner side of the cellular membrane. Once converted to an acyl-CoA thioester a fatty acid can enter the following biochemical pathways: 1) peroxisomal beta-oxidation, 2) triacylglyceride synthesis, 3) cholesteryl ester synthesis or 4) phospholipid synthesis. All of these possible fates for fatty acyl-CoA can prevent the metabolism of an imported fatty acid into a dicarboxylic acid and result in a low yield production of dicarboxylic acids from fatty acid feedstocks. Therefore, in some embodiments, strains are being developed with a mutant Fat1p enzyme (i.e., Fat1p-mut), that retains fatty acid transport activity (e.g., the ability to transport fatty acids across the cellular membrane) but lacks a thioesterase activity (e.g., the ability to activate a fatty acid to an acyl-CoA thioester). Fat1p mutants have been described in the literature for *S. cerevisiae*. Some such mutants are known in the literature and correspond to the mutants S244A or D495A in the *Candida* strain ATCC20336 Fat1p enzyme.

Knocking Out Transport into the Peroxisome

The mechanism of transport of fatty acids into the peroxisome differs based upon the chain length of the fatty acid. Long chain fatty acids, C16-C18, are not able to diffuse across the peroxisomal membrane in free acid form but are instead transported across as fatty acyl-CoA esters in an ATP-dependent process catalyzed by the Pxa1p/Pxa2p heterodimer (e.g. EC 3.6.3.47). Short and medium chain fatty acids, C6-C14, are thought to be able to diffuse across the peroxisomal membrane in the free acid form, however may also by aided in transport into the peroxisomal matrix by Pex11p or by other as yet unknown transporters. In some embodiments, knocking out the genes encoding these transport proteins would again improve diacid yields by redirecting exogenously supplied fatty acids from biochemical use in the peroxisome to the ω-oxidation pathway.

Examples of the sequences of Pxa1p, Pxa2p and Pex11p from *Candida* strain ATCC20336 are shown below.

*Candida* strain ATCC20336_PXA1—SEQ ID NO: 92
*Candida* strain ATCC20336_PXA2—SEQ ID NO: 94
*Candida* strain ATCC20336_PEX11—SEQ ID NO: 96

Acyl-CoA Sterol Acyltransferase

The term "a genetic modification that results in increased fatty acid synthesis" as used herein also refers to a genetic alteration of a host microorganism that reduces an endogenous activity that converts fatty acids into cholesterol esters. In some embodiments, an endogenous activity that converts fatty acids into cholesterol esters is reduced. In certain embodiments, an acyl-CoA sterol acyltransferase activity is reduced. Such alterations can advantageously increase yields of end products, such as a fatty dicarboxylic acid (e.g., octanedioic acid, decanedioic acid, dodecanedioic acid, tetradecanedioic acid, hexadecanedioic acid, octadecanedioic acid, eicosanedioic acid).

Fatty acids can be converted into a cholesterol-ester by the activity of acyl-CoA sterol acyltransferase (e.g., ARE1, ARE2, EC 2.3.1.26; also referred to as sterol O-acyltransferase; cholesterol acyltransferase; sterol-ester synthase; sterol-ester synthetase; sterol-ester synthase; acyl coenzyme A-cholesterol-O-acyltransferase; acyl-CoA:cholesterol acyltransferase; ACAT; acylcoenzyme A:cholesterol O-acyltransferase; cholesterol ester synthase; cholesterol ester synthetase; and cholesteryl ester synthetase), in many organisms. Without being limited by any theory, cholesterol esterification may be involved in directing fatty acids away from incorporation into cell membranes and towards storage forms of lipids. Acyl-CoA sterol acyltransferase catalyzes the reaction, acyl-CoA+cholesterol=CoA+cholesterol ester.

The esterification of cholesterol is believed to limit its solubility in cell membrane lipids and thus promotes accumulation of cholesterol ester in the fat droplets (e.g., a form of carbon storage molecule) within cytoplasm. Therefore, without being limited by any theory esterification of cholesterol may cause the accumulation of lipid storage molecules, and disruption of the activity of acyl-CoA sterol acyltransferase may cause an increase in acyl-CoA levels that can be converted into a fatty dicarboxylic acid (e.g., octanedioic acid, decanedioic acid, dodecanedioic acid, tetradecanedioic acid, hexadecanedioic acid, octadecanedioic acid, eicosanedioic acid) by other engineered pathways in the same host organism (e.g., omega oxidation pathway, beta oxidation pathway, omega oxidation pathway and beta oxidation pathway). Acyl-CoA sterol acyltransferase can be inactivated by any suitable means. Described herein are gene knockout methods suitable for disrupting nucleotide sequences that encode polypeptides having ARE1 activity, ARE2 activity or ARE1 activity and ARE2 activity. The nucleotide sequences of ARE1 and ARE2 are provided in Example 33, SEQ ID NOS: 43 and 45. DNA vectors suitable for use in constructing "knockout" constructs are described herein.

The presence, absence or amount of acyl-CoA sterol acyltransferase activity can be detected by any suitable method known in the art. Non-limiting examples of suitable detection methods include enzymatic assays (e.g., Chen et al, Plant Physiology 145:974-984 (2007)), binding assays, PCR based assays (e.g., qPCR, RT-PCR), immunological detection methods (e.g., antibodies specific for long-chain-acyl-CoA synthetase), the like and combinations thereof.

Diacylglycerol Acyltransferase & Acyltransferases

The term "a genetic modification that results in increased fatty acid synthesis" as used herein also refers to a genetic alteration of a host microorganism that reduces an endogenous activity that catalyzes diacylglycerol esterification (e.g., addition of acyl group to a diacylglycerol to form a triacylglycerol). In some embodiments, an endogenous activity that converts diacylglycerol into triacylglycerol is reduced. In certain embodiments, an acyltransferase activity is reduced. In some embodiments a diacylglycerol acyltransferase activity is reduced. In some embodiments a diacylglycerol acyltransferase (e.g., DGA1, EC 2.3.1.20) activity and an acyltransferase (e.g., LRO1) activity are reduced. Such alterations can advantageously increase yields of end products, such as a fatty dicarboxylic acid (e.g., octanedioic acid, decanedioic acid, dodecanedioic acid, tetradecanedioic acid, hexadecanedioic acid, octadecanedioic acid, eicosanedioic acid).

Diacylglycerol can be converted into triacylglycerol by the activity of diacylglycerol acyltransferase (e.g., DGA1; EC 2.3.1.20; also referred to as diglyceride acyltransferase; 1,2-diacylglycerol acyltransferase; diacylglycerol acyltransferase; diglyceride O-acyltransferase; palmitoyl-CoA-sn-1, 2-diacylglycerol acyltransferase; acyl-CoA:1,2-diacylglycerol O-acyltransferase and acyl-CoA:1,2-diacyl-sn-glycerol O-acyltransferase), in many organisms. Diacylglycerol acyltransferase catalyzes the reaction,

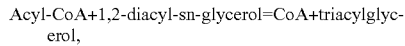

Acyl-CoA+1,2-diacyl-sn-glycerol=CoA+triacylglycerol, and is generally considered the terminal and only committed step in triglyceride synthesis. The product of the DGA1 gene in yeast normally is localized to lipid particles.

In addition to the diacylglycerol esterification activity described for DGA1, many organisms also can generate triglycerides by the activity of other acyltransferase activities, non-limiting examples of which include lecithin-cholesterol acyltransferase activity (e.g., LRO1; EC 2.3.1.43; also referred to as phosphatidylcholine-sterol O-acyltransferase activity; lecithin-cholesterol acyltransferase activity; phospholipid-cholesterol acyltransferase activity; LCAT (lecithin-cholesterol acyltransferase) activity; lecithin:cholesterol acyltransferase activity; and lysolecithin acyltransferase activity) and phospholipid:diacylglycerol acyltransferase (e.g., EC 2.3.1.158; also referred to as PDAT activity and phospholipid:1,2-diacyl-sn-glycerol O-acyltransferase activity). Acyltransferases of the families EC 2.3.1.43 and EC 2.3.1.58 catalyze the general reaction,

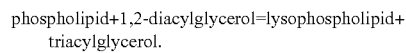

phospholipid+1,2-diacylglycerol=lysophospholipid+triacylglycerol.

Triacylglycerides often are utilized as carbon (e.g., fatty acid or lipid) storage molecules. Without being limited by any theory, it is believe that reducing the activity of acyltransferase may reduce the conversion of diacylglycerol to triacylglycerol, which may cause increased accumulation of fatty acid, in conjunction with additional genetic modifications (e.g., lipase to further remove fatty acids from the glycerol backbone) that can be converted into a fatty dicarboxylic acid (e.g., octanedioic acid, decanedioic acid, dodecanedioic acid, tetradecanedioic acid, hexadecanedioic acid, octadecanedioic acid, eicosanedioic acid) by other engineered pathways in the same host organism (e.g., omega oxidation pathway, beta oxidation pathway, omega oxidation pathway and beta oxidation pathway). Acyltransferases can be inactivated by any suitable means. Described herein are gene knockout methods suitable for disrupting nucleotide sequences that encode polypeptides having DGA1 activity, LRO1 activity or DGA1 activity and LRO1 activity. The nucleotide sequence of DGA1 is provided in Example 33, SEQ ID NO: 47 The nucleotide sequence of LRO1 is provided in Example 33, SEQ ID NO: 49. DNA vectors suitable for use in constructing "knockout" constructs are described herein. The genes ARE1 and ARE2 in S. cerevisiae are also involved in triacylglyceride synthesis. Knocking out genes encoding these enzymes can redirect exogenously supplied fatty acids to ω-oxidation.

The presence, absence or amount of acyltransferase activity can be detected by any suitable method known in the art. Non-limiting examples of suitable detection methods include enzymatic assays (e.g., Geelen, Analytical Biochemistry 322(2):264-268 (2003), Dahlqvist et al, PNAS 97(12): 6487-6492 (2000)), binding assays, PCR based assays (e.g., qPCR, RTPCR), immunological detection methods (e.g., antibodies specific for a DGA1 or LRO1 acyltransferase), the like and combinations thereof.

Carnitine Acetyltransferase

Carnitine acetyltransferase (i.e., Cat2, Cat2p) is an enzyme targeted to both the peroxisomal and mitochondrial compartments. It catalyzes the transfer of an acetyl group from a CoA group to a carnitine (or vice versa depending on location) as shown below.

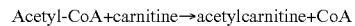

Acetyl-CoA+carnitine→acetylcarnitine+CoA

An acetyl-carnitine molecule is transported across the peroxisomal and mitochondrial membranes whereas an acetyl-CoA molecule is not. Therefore the action of Cat2 (e.g., 2.3.1.7) provides one of three possible routes for acetyl groups to leave the peroxisome. Acetyl-CoA produced by beta-oxidation can be converted to acetyl-carnitine and transported to the mitochondria for entry into the TCA cycle. In some embodiments, the activity of Cat2 is decreased or eliminated in order to slow the exit of acetyl-CoA from the peroxisome. In some embodiments, providing a bottle-neck downstream of the adipic acid intermediate that is derived from beta-oxidation is a strategy for improving the yield of adipic acid.

Carnitine O-Acyltransferase

Carnitine O-acyltransferase (i.e., CROT, e.g., 2.3.1.137) is a peroxisomal enzyme that can transfer an acyl chain from a CoA group to a carnitine group as shown below.

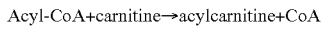

Acyl-CoA+carnitine→acylcarnitine+CoA

The acyl-carnitine produced may then be transported out of the peroxisome for use elsewhere in the cell. The enzyme may act on acyl chains of different chain lengths but is most active on short chains (C6-C8). Diacids that are prematurely pulled out of beta-oxidation and sent to other cellular compartments can represent a yield loss.

UDP-Glucosyltransferase

The UDP-glucosyltransferase enzyme (i.e., UGTA1, UgtA1p, e.g., 2.4.1.-) performs the first reaction in the synthesis of sophorolipids. Sophorolipids are a class of biosurfactant molecules produced by some yeast when exposed to hydrophobic environments. They are made up of sophorose (2-O-β-D-glucopyranosyl-D-glucopyranose) attached through its anomeric carbon to an ω- or (ω-1)-hydroxylated fatty acid of 16 or 18 carbons. The most well-known yeast for producing sophorolipids is *Candida bombicola*. The pathway for sophorolipid production in this yeast proceeds via a step-wise transfer of two glucose molecules to a hydroxy-fatty acid. The first step is carried out by UgtA1p and the second step by UgtB1p (Saerens K M J, Roelants S L K W, VanBogaert I N A, Soetaert W (2011) FEMS Yeast Res 11: 123-132; Saerens K M J, Zhang J, Saey L, VanBogaert I N A, Soetaert W (2011) Yeast 28: 279-292). The stepwise transfer of glucose from UDP-glucose to the ω-end of the hydroxyl-fatty acid could represent a yield loss if ω-hydroxy fatty acids produced in the first step of ω-oxidation are pulled into sophorolipid production rather than diacid production.

Elongase(s)

"Elongase(s)" means those enzyme(s) in an organism that have ability to (i) extend the chain length of fatty acyl-CoA molecules, as for example converting C-12 to C-16 fatty acyl-CoA molecules to C16-C18 fatty acids; (ii) elongate palmitoyl-CoA and stearoyl-CoA up to about 22 carbon fatty acids; or (iii) synthesize longer chain carbon fatty acids from shorter chain CoA primers such as C-18-CoA. In some embodiments, the expression of an elongase is decreased or knocked out in a fatty dicarboxylic acid producing yeast.

Polynucleotides and Polypeptides

A nucleic acid (e.g., also referred to herein as nucleic acid reagent, target nucleic acid, target nucleotide sequence, nucleic acid sequence of interest or nucleic acid region of interest) can be from any source or composition, such as DNA, cDNA, gDNA (genomic DNA), RNA, siRNA (short inhibitory RNA), RNAi, tRNA or mRNA, for example, and can be in any form (e.g., linear, circular, supercoiled, single-stranded, double-stranded, and the like). A nucleic acid can also comprise DNA or RNA analogs (e.g., containing base analogs, sugar analogs and/or a non-native backbone and the like). It is understood that the term "nucleic acid" does not refer to or infer a specific length of the polynucleotide chain, thus polynucleotides and oligonucleotides are also included in the definition. Deoxyribonucleotides include deoxyadenosine, deoxycytidine, deoxyguanosine and deoxythymidine. For RNA, the uracil base is uridine.

A nucleic acid sometimes is a plasmid, phage, autonomously replicating sequence (ARS), centromere, artificial chromosome, yeast artificial chromosome (e.g., YAC) or other nucleic acid able to replicate or be replicated in a host cell. In certain embodiments a nucleic acid can be from a library or can be obtained from enzymatically digested, sheared or sonicated genomic DNA (e.g., fragmented) from an organism of interest. In some embodiments, nucleic acid subjected to fragmentation or cleavage may have a nominal, average or mean length of about 5 to about 10,000 base pairs, about 100 to about 1,000 base pairs, about 100 to about 500 base pairs, or about 10, 15, 20, 25, 30, 35, 40, 45, 50, 55, 60, 65, 70, 75, 80, 85, 90, 95, 100, 200, 300, 400, 500, 600, 700, 800, 900, 1000, 2000, 3000, 4000, 5000, 6000, 7000, 8000, 9000 or 10000 base pairs. Fragments can be generated by any suitable method in the art, and the average, mean or nominal length of nucleic acid fragments can be controlled by selecting an appropriate fragment-generating procedure by the person of ordinary skill. In some embodiments, the fragmented DNA can be size selected to obtain nucleic acid fragments of a particular size range.

Nucleic acid can be fragmented by various methods known to the person of ordinary skill, which include without limitation, physical, chemical and enzymic processes. Examples of such processes are described in U.S. Patent Application Publication No. 20050112590 (published on May 26, 2005, entitled "Fragmentation-based methods and systems for sequence variation detection and discovery," naming Van Den Boom et al.). Certain processes can be selected by the person of ordinary skill to generate non-specifically cleaved fragments or specifically cleaved fragments. Examples of processes that can generate non-specifically cleaved fragment sample nucleic acid include, without limitation, contacting sample nucleic acid with apparatus that expose nucleic acid to shearing force (e.g., passing nucleic acid through a syringe needle; use of a French press); exposing sample nucleic acid to irradiation (e.g., gamma, x-ray, UV irradiation; fragment sizes can be controlled by irradiation intensity); boiling nucleic acid in water (e.g., yields about 500 base pair fragments) and exposing nucleic acid to an acid and base hydrolysis process.

Nucleic acid may be specifically cleaved by contacting the nucleic acid with one or more specific cleavage agents. The term "specific cleavage agent" as used herein refers to an agent, sometimes a chemical or an enzyme that can cleave a nucleic acid at one or more specific sites. Specific cleavage agents often will cleave specifically according to a particular nucleotide sequence at a particular site. Examples of enzymic specific cleavage agents include without limitation endonucleases (e.g., DNase (e.g., DNase I, II); RNase (e.g., RNase E, F, H, P); Cleavase™ enzyme; Taq DNA polymerase; *E. coli* DNA polymerase I and eukaryotic structure-specific endonucleases; murine FEN-1 endonucleases; type I, II or III restriction endonucleases such as Acc I, Afl III, Alu I, Alw44 I, Apa I, Asn I, Ava I, Ava II, BamH I, Ban II, Bcl I, Bgl I. Bgl II, Bln I, Bsm I, BssH II, BstE II, Cfo I, Cla I, Dde I, Dpn I, Dra I, EcIX I, EcoR I, EcoR I, EcoR II, EcoR V, Hae II, Hae II, Hind II, Hind III, Hpa I, Hpa II, Kpn I, Ksp I, Mlu I, MluN I, Msp I, Nci I, Nco I, Nde I, Nde II, Nhe I, Not I, Nru I, Nsi I, Pst I, Pvu I, Pvu II, Rsa I, Sac I, Sal I, Sau3A I, Sca I, ScrF I, Sfi I, Sma I, Spe I, Sph I, Ssp I, Stu I, Sty I, Swa I, Taq I, Xba I, Xho I); glycosylases (e.g., uracil-DNA glycolsylase (UDG), 3-methyladenine DNA glycosylase, 3-methyladenine DNA glycosylase II, pyrimidine hydrate-DNA glycosylase, FaPy-DNA glycosylase, thymine mismatch-DNA glycosylase, hypoxanthine-DNA glycosylase, 5-Hydroxymethyluracil DNA glycosylase (HmUDG), 5-Hydroxymethylcytosine DNA glycosylase, or 1,N6-etheno-adenine DNA glycosylase); exonucleases (e.g., exonuclease III); ribozymes, and DNA-zymes. Sample nucleic acid may be treated with a chemical agent, or synthesized using modified nucleotides, and the modified nucleic acid may be cleaved. In non-limiting examples, sample nucleic acid may be treated with (i) alkylating agents such as methylnitrosourea that generate several alkylated bases, including N3-methyladenine and N3-methylguanine, which are recognized and cleaved by alkyl purine DNA-glycosylase; (ii) sodium bisulfite, which causes deamination of cytosine residues in DNA to form uracil residues that can be cleaved by uracil N-glycosylase; and (iii) a chemical agent that converts guanine to its oxidized form, 8-hydroxyguanine, which can be cleaved by formamidopyrimidine DNA N-glycosylase. Examples of chemical cleavage processes include without limitation alkylation, (e.g., alkylation of phosphorothioate-modified nucleic acid); cleavage of acid lability of P3'-N5'-phosphoroamidate-containing nucleic acid; and osmium tetroxide and piperidine treatment of nucleic acid.

As used herein, the term "complementary cleavage reactions" refers to cleavage reactions that are carried out on the same nucleic acid using different cleavage reagents or by altering the cleavage specificity of the same cleavage reagent such that alternate cleavage patterns of the same target or reference nucleic acid or protein are generated. In certain embodiments, nucleic acids of interest may be treated with one or more specific cleavage agents (e.g., 1, 2, 3, 4, 5, 6, 7, 8, 9, 10 or more specific cleavage agents) in one or more reaction vessels (e.g., nucleic acid of interest is treated with each specific cleavage agent in a separate vessel).

A nucleic acid suitable for use in the embodiments described herein sometimes is amplified by any amplification process known in the art (e.g., PCR, RT-PCR and the like). Nucleic acid amplification may be particularly beneficial when using organisms that are typically difficult to culture (e.g., slow growing, require specialize culture conditions and the like). The terms "amplify", "amplification", "amplification reaction", or "amplifying" as used herein refer to any in vitro processes for multiplying the copies of a target sequence of nucleic acid. Amplification sometimes refers to an "exponential" increase in target nucleic acid. However, "amplifying" as used herein can also refer to linear increases in the numbers of a select target sequence of nucleic acid, but is different than a one-time, single primer extension step. In some embodiments, a limited amplification reaction, also known as pre-amplification, can be performed. Pre-amplification is a method in which a limited amount of amplification occurs due to a small number of cycles, for example 10 cycles, being performed. Pre-amplification can allow some amplification, but stops amplification prior to the exponential phase, and typically produces about 500 copies of the desired nucleotide sequence(s). Use of pre-amplification may also limit inaccuracies associated with depleted reactants in standard PCR reactions.

In some embodiments, a nucleic acid reagent sometimes is stably integrated into the chromosome of the host organism, or a nucleic acid reagent can be a deletion of a portion of the host chromosome, in certain embodiments (e.g., genetically modified organisms, where alteration of the host genome confers the ability to selectively or preferentially maintain the desired organism carrying the genetic modification). Such nucleic acid reagents (e.g., nucleic acids or genetically modified organisms whose altered genome confers a selectable trait to the organism) can be selected for their ability to guide production of a desired protein or nucleic acid molecule. When desired, the nucleic acid reagent can be altered such that codons encode for (i) the same amino acid, using a different tRNA than that specified in the native sequence, or (ii) a different amino acid than is normal, including unconventional or unnatural amino acids (including detectably labeled amino acids). As described herein, the term "native sequence" refers to an unmodified nucleotide sequence as found in its natural setting (e.g., a nucleotide sequence as found in an organism).

A nucleic acid or nucleic acid reagent can comprise certain elements often selected according to the intended use of the nucleic acid. Any of the following elements can be included in or excluded from a nucleic acid reagent. A nucleic acid reagent, for example, may include one or more or all of the following nucleotide elements: one or more promoter elements, one or more 5' untranslated regions (5'UTRs), one or more regions into which a target nucleotide sequence may be inserted (an "insertion element"), one or more target nucleotide sequences, one or more 3' untranslated regions (3'UTRs), and one or more selection elements. A nucleic acid reagent can be provided with one or more of such elements and other elements may be inserted into the nucleic acid before the nucleic acid is introduced into the desired organism. In some embodiments, a provided nucleic acid reagent comprises a promoter, 5'UTR, optional 3'UTR and insertion element(s) by which a target nucleotide sequence is inserted (i.e., cloned) into the nucleotide acid reagent. In certain embodiments, a provided nucleic acid reagent comprises a promoter, insertion element(s) and optional 3'UTR, and a 5' UTR/target nucleotide sequence is inserted with an optional 3'UTR. The elements can be arranged in any order suitable for expression in the chosen expression system (e.g., expression in a chosen organism, or expression in a cell free system, for example), and in some embodiments a nucleic acid reagent comprises the following elements in the 5' to 3' direction: (1) promoter element, 5'UTR, and insertion element(s); (2) promoter element, 5'UTR, and target nucleotide sequence; (3) promoter element, 5'UTR, insertion element(s) and 3'UTR; and (4) promoter element, 5'UTR, target nucleotide sequence and 3'UTR.

Promoters

A promoter element typically is required for DNA synthesis and/or RNA synthesis. A promoter element often comprises a region of DNA that can facilitate the transcription of a particular gene, by providing a start site for the synthesis of RNA corresponding to a gene.

Promoters generally are located near the genes they regulate, are located upstream of the gene (e.g., 5' of the gene), and are on the same strand of DNA as the sense strand of the gene, in some embodiments. In some embodiments, a promoter element can be isolated from a gene or organism and inserted in functional connection with a polynucleotide sequence to allow altered and/or regulated expression. A non-native promoter (e.g., promoter not normally associated with a given nucleic acid sequence) used for expression of a nucleic acid often is referred to as a heterologous promoter. In certain embodiments, a heterologous promoter and/or a 5'UTR can be inserted in functional connection with a polynucleotide that encodes a polypeptide having a desired activity as described herein. The terms "operably linked" and "in functional connection with" as used herein with respect to promoters, refer to a relationship between a coding sequence and a promoter element. The promoter is operably linked or in functional connection with the coding sequence when expression from the coding sequence via transcription is regulated, or controlled by, the promoter element. The terms "operably linked" and "in functional connection with" are utilized interchangeably herein with respect to promoter elements.

A promoter often interacts with a RNA polymerase. A polymerase is an enzyme that catalyses synthesis of nucleic acids using a preexisting nucleic acid reagent. When the template is a DNA template, an RNA molecule is transcribed before protein is synthesized. Enzymes having polymerase activity suitable for use in the present methods include any polymerase that is active in the chosen system with the chosen template to synthesize protein. In some embodiments, a promoter (e.g., a heterologous promoter) also referred to herein as a promoter element, can be operably linked to a nucleotide sequence or an open reading frame (ORF). Transcription from the promoter element can catalyze the synthesis of an RNA corresponding to the nucleotide sequence or ORF sequence operably linked to the promoter, which in turn leads to synthesis of a desired peptide, polypeptide or protein.

Promoter elements sometimes exhibit responsiveness to regulatory control. Promoter elements also sometimes can be regulated by a selective agent. That is, transcription from promoter elements sometimes can be turned on, turned off, up-regulated or down-regulated, in response to a change in environmental, nutritional or internal conditions or signals (e.g., heat inducible promoters, light regulated promoters, feedback regulated promoters, hormone influenced promoters, tissue specific promoters, oxygen and pH influenced promoters, promoters that are responsive to selective agents (e.g., kanamycin) and the like, for example). Promoters influenced by environmental, nutritional or internal signals frequently are influenced by a signal (direct or indirect) that binds at or near the promoter and increases or decreases expression of the target sequence under certain conditions.

Non-limiting examples of selective or regulatory agents that can influence transcription from a promoter element used in embodiments described herein include, without limitation, (1) nucleic acid segments that encode products that provide resistance against otherwise toxic compounds (e.g., antibiotics); (2) nucleic acid segments that encode products that are otherwise lacking in the recipient cell (e.g., essential products, tRNA genes, auxotrophic markers); (3) nucleic acid segments that encode products that suppress the activity of a gene product; (4) nucleic acid segments that encode products that can be readily identified (e.g., phenotypic markers such as antibiotics (e.g., β-lactamase), β-galactosidase, green fluorescent protein (GFP), yellow fluorescent protein (YFP), red fluorescent protein (RFP), cyan fluorescent protein (CFP), and cell surface proteins); (5) nucleic acid segments that bind products that are otherwise detrimental to cell survival and/or function; (6) nucleic acid segments that otherwise inhibit the activity of any of the nucleic acid segments described in Nos. 1-5 above (e.g., antisense oligonucleotides); (7) nucleic acid segments that bind products that modify a substrate (e.g., restriction endonucleases); (8) nucleic acid segments that can be used to isolate or identify a desired molecule (e.g., specific protein binding sites); (9) nucleic acid segments that encode a specific nucleotide sequence that can be otherwise non-functional (e.g., for PCR amplification of subpopulations of molecules); (10) nucleic acid segments that, when absent, directly or indirectly confer resistance or sensitivity to particular compounds; (11) nucleic acid segments that encode products that either are toxic or convert a relatively non-toxic compound to a toxic compound (e.g., Herpes simplex thymidine kinase, cytosine deaminase) in recipient cells; (12) nucleic acid segments that inhibit replication, partition or heritability of nucleic acid molecules that contain them; and/or (13) nucleic acid segments that encode conditional replication functions, e.g., replication in certain hosts or host cell strains or under certain environmental conditions (e.g., temperature, nutritional conditions, and the like). In some embodiments, the regulatory or selective agent can be added to change the existing growth conditions to which the organism is subjected (e.g., growth in liquid culture, growth in a fermenter, growth on solid nutrient plates and the like for example).

In some embodiments, regulation of a promoter element can be used to alter (e.g., increase, add, decrease or substantially eliminate) the activity of a peptide, polypeptide or protein (e.g., enzyme activity for example). For example, a microorganism can be engineered by genetic modification to express a nucleic acid reagent that can add a novel activity (e.g., an activity not normally found in the host organism) or increase the expression of an existing activity by increasing transcription from a homologous or heterologous promoter operably linked to a nucleotide sequence of interest (e.g., homologous or heterologous nucleotide sequence of interest), in certain embodiments. In some embodiments, a microorganism can be engineered by genetic modification to express a nucleic acid reagent that can decrease expression of an activity by decreasing or substantially eliminating transcription from a homologous or heterologous promoter operably linked to a nucleotide sequence of interest, in certain embodiments.

In some embodiments the activity can be altered using recombinant DNA and genetic techniques known to the artisan. Methods for engineering microorganisms are further described herein. Tables herein provide non-limiting lists of yeast promoters that are up-regulated by oxygen, yeast promoters that are down-regulated by oxygen, yeast transcriptional repressors and their associated genes, DNA binding motifs as determined using the MEME sequence analysis software. Potential regulator binding motifs can be identified using the program MEME to search intergenic regions bound by regulators for overrepresented sequences. For each regulator, the sequences of intergenic regions bound with p-values less than 0.001 were extracted to use as input for motif discovery. The MEME software was run using the following settings: a motif width ranging from 6 to 18 bases, the "zoops" distribution model, a $6^{th}$ order Markov background model and a discovery limit of 20 motifs. The discovered sequence motifs were scored for significance by two criteria: an E-value calculated by MEME and a specificity score. The motif with the best score using each metric is shown for each regulator. All motifs presented are derived from datasets generated in rich growth conditions with the exception of a previously published dataset for epitope-tagged Gal4 grown in galactose.

In some embodiments, the altered activity can be found by screening the organism under conditions that select for the desired change in activity. For example, certain microorganisms can be adapted to increase or decrease an activity by selecting or screening the organism in question on a media containing substances that are poorly metabolized or even toxic. An increase in the ability of an organism to grow a substance that is normally poorly metabolized may result in an increase in the growth rate on that substance, for example. A decrease in the sensitivity to a toxic substance might be manifested by growth on higher concentrations of the toxic substance, for example. Genetic modifications that are identified in this manner sometimes are referred to as naturally occurring mutations or the organisms that carry them can sometimes be referred to as naturally occurring mutants. Modifications obtained in this manner are not limited to alterations in promoter sequences. That is, screening microorganisms by selective pressure, as described above, can yield genetic alterations that can occur in non-promoter sequences, and sometimes also can occur in sequences that are not in the nucleotide sequence of interest, but in a related nucleotide sequences (e.g., a gene involved in a different step of the same pathway, a transport gene, and the like). Naturally occurring mutants sometimes can be found by isolating naturally occurring variants from unique environments, in some embodiments.

Homology and Identity

In addition to the regulated promoter sequences, regulatory sequences, and coding polynucleotides provided herein, a nucleic acid reagent may include a polynucleotide sequence 80% or more identical to the foregoing (or to the complementary sequences). That is, a nucleotide sequence that is at least 80% or more, 81% or more, 82% or more, 83% or more, 84% or more, 85% or more, 86% or more, 87% or more, 88% or more, 89% or more, 90% or more, 91% or more, 92% or more, 93% or more, 94% or more, 95% or more, 96% or more, 97% or more, 98% or more, or 99% or more identical to a nucleotide sequence described herein can be utilized. The term "identical" as used herein refers to two or more nucleotide sequences having substantially the same nucleotide sequence when compared to each other. One test for determining whether two nucleotide sequences or amino acids sequences are substantially identical is to determine the percent of identical nucleotide sequences or amino acid sequences shared.

Calculations of sequence identity can be performed as follows. Sequences are aligned for optimal comparison purposes (e.g., gaps can be introduced in one or both of a first and a second amino acid or nucleic acid sequence for optimal alignment and non-homologous sequences can be disregarded for comparison purposes). The length of a reference sequence aligned for comparison purposes is sometimes 30% or more, 40% or more, 50% or more, often 60% or more, and more often 70% or more, 80% or more, 90% or more, or 100% of the length of the reference sequence. The nucleotides or amino acids at corresponding nucleotide or polypeptide positions, respectively, are then compared among the two sequences. When a position in the first sequence is occupied by the same nucleotide or amino acid as the corresponding position in the second sequence, the nucleotides or amino acids are deemed to be identical at that position. The percent identity between the two sequences is a function of the number of identical positions shared by the sequences, taking into account the number of gaps, and the length of each gap, introduced for optimal alignment of the two sequences.

Comparison of sequences and determination of percent identity between two sequences can be accomplished using a mathematical algorithm. Percent identity between two amino acid or nucleotide sequences can be determined using the algorithm of Meyers & Miller, CABIOS 4: 11-17 (1989), which has been incorporated into the ALIGN program (version 2.0), using a PAM120 weight residue table, a gap length penalty of 12 and a gap penalty of 4. Also, percent identity between two amino acid sequences can be determined using the Needleman & Wunsch, J. Mol. Biol. 48: 444-453 (1970) algorithm which has been incorporated into the GAP program in the GCG software package, using either a Blossum 62 matrix or a PAM250 matrix, and a gap weight of 16, 14, 12, 10, 8, 6, or 4 and a length weight of 1, 2, 3, 4, 5, or 6. Percent identity between two nucleotide sequences can be determined using the GAP program in the GCG software package, using a NWSgapdna.CMP matrix and a gap weight of 40, 50, 60, 70, or 80 and a length weight of 1, 2, 3, 4, 5, or 6. A set of parameters often used is a Blossum 62 scoring matrix with a gap open penalty of 12, a gap extend penalty of 4, and a frameshift gap penalty of 5.

Sequence identity can also be determined by hybridization assays conducted under stringent conditions. As use herein, the term "stringent conditions" refers to conditions for hybridization and washing. Stringent conditions are known to those skilled in the art and can be found in Current Protocols in Molecular Biology, John Wiley & Sons, N.Y., 6.3.1-6.3.6 (1989). Aqueous and non-aqueous methods are described in that reference and either can be used. An example of stringent hybridization conditions is hybridization in 6× sodium chloride/sodium citrate (SSC) at about 45° C., followed by one or more washes in 0.2×SSC, 0.1% SDS at 50° C. Another example of stringent hybridization conditions are hybridization in 6× sodium chloride/sodium citrate (SSC) at about 45° C., followed by one or more washes in 0.2×SSC, 0.1% SDS at 55° C. A further example of stringent hybridization conditions is hybridization in 6× sodium chloride/sodium citrate (SSC) at about 45° C., followed by one or more washes in 0.2×SSC, 0.1% SDS at 60° C. Often, stringent hybridization conditions are hybridization in 6× sodium chloride/sodium citrate (SSC) at about 45° C., followed by one or more washes in 0.2×SSC, 0.1% SDS at 65° C. More often, stringency conditions are 0.5M sodium phosphate, 7% SDS at 65° C., followed by one or more washes at 0.2×SSC, 1% SDS at 65° C.

UTRs

As noted above, nucleic acid reagents may also comprise one or more 5' UTR's, and one or more 3'UTR's. A 5' UTR may comprise one or more elements endogenous to the nucleotide sequence from which it originates, and sometimes includes one or more exogenous elements. A 5' UTR can originate from any suitable nucleic acid, such as genomic DNA, plasmid DNA, RNA or mRNA, for example, from any suitable organism (e.g., virus, bacterium, yeast, fungi, plant, insect or mammal). The artisan may select appropriate elements for the 5' UTR based upon the chosen expression system (e.g., expression in a chosen organism, or expression in a cell free system, for example). A 5' UTR sometimes comprises one or more of the following elements known to the artisan: enhancer sequences (e.g., transcriptional or translational), transcription initiation site, transcription factor binding site, translation regulation site, translation initiation site, translation factor binding site, accessory protein binding site, feedback regulation agent binding sites, Pribnow box, TATA box, −35 element, E-box (helix-loop-helix binding element), ribosome binding site, replicon, internal ribosome entry site (IRES), silencer element and the like. In some embodiments, a promoter element may be isolated such that all 5' UTR elements necessary for proper conditional regulation are contained in the promoter element fragment, or within a functional subsequence of a promoter element fragment.

A 5' UTR in the nucleic acid reagent can comprise a translational enhancer nucleotide sequence. A translational enhancer nucleotide sequence often is located between the promoter and the target nucleotide sequence in a nucleic acid reagent. A translational enhancer sequence often binds to a ribosome, sometimes is an 18S rRNA-binding ribonucleotide sequence (i.e., a 40S ribosome binding sequence) and sometimes is an internal ribosome entry sequence (IRES). An IRES generally forms an RNA scaffold with precisely placed RNA tertiary structures that contact a 40S ribosomal subunit via a number of specific intermolecular interactions. Examples of ribosomal enhancer sequences are known and can be identified by the artisan (e.g., Mignone et al., Nucleic Acids Research 33: D141-D146 (2005); Paulous et al., Nucleic Acids Research 31: 722-733 (2003); Akbergenov et al., Nucleic Acids Research 32: 239-247 (2004); Mignone et al., Genome Biology 3(3): reviews0004.1-0001.10 (2002); Gallie, Nucleic Acids Research 30: 3401-3411 (2002); Shaloiko et al., DOI: 10.1002/bit.20267; and Gallie et al., Nucleic Acids Research 15: 3257-3273 (1987)).

A translational enhancer sequence sometimes is a eukaryotic sequence, such as a Kozak consensus sequence or other sequence (e.g., hydroid polyp sequence, GenBank accession no. U07128). A translational enhancer sequence sometimes is a prokaryotic sequence, such as a Shine-Dalgarno consensus sequence. In certain embodiments, the translational enhancer sequence is a viral nucleotide sequence. A translational enhancer sequence sometimes is from a 5' UTR of a plant virus, such as Tobacco Mosaic Virus (TMV), Alfalfa Mosaic Virus (AMV); Tobacco Etch Virus (ETV); Potato Virus Y (PVY); Turnip Mosaic (poty) Virus and Pea Seed Borne Mosaic Virus, for example. In certain embodiments, an omega sequence about 67 bases in length from TMV is included in the nucleic acid reagent as a translational enhancer sequence (e.g., devoid of guanosine nucleotides and includes a 25 nucleotide long poly (CAA) central region).

A 3' UTR may comprise one or more elements endogenous to the nucleotide sequence from which it originates and sometimes includes one or more exogenous elements. A 3' UTR may originate from any suitable nucleic acid, such as genomic DNA, plasmid DNA, RNA or mRNA, for example, from any suitable organism (e.g., a virus, bacterium, yeast, fungi, plant, insect or mammal). The artisan can select appropriate elements for the 3' UTR based upon the chosen expression system (e.g., expression in a chosen organism, for example). A 3' UTR sometimes comprises one or more of the following elements known to the artisan: transcription regulation site, transcription initiation site, transcription termination site, transcription factor binding site, translation regulation site, translation termination site, translation initiation site, translation factor binding site, ribosome binding site, replicon, enhancer element, silencer element and polyadenosine tail. A 3' UTR often includes a polyadenosine tail and sometimes does not, and if a polyadenosine tail is present, one or more adenosine moieties may be added or deleted from it (e.g., about 5, about 10, about 15, about 20, about 25, about 30, about 35, about 40, about 45 or about 50 adenosine moieties may be added or subtracted).

In some embodiments, modification of a 5' UTR and/or a 3' UTR can be used to alter (e.g., increase, add, decrease or substantially eliminate) the activity of a promoter. Alteration of the promoter activity can in turn alter the activity of a peptide, polypeptide or protein (e.g., enzyme activity for example), by a change in transcription of the nucleotide sequence(s) of interest from an operably linked promoter element comprising the modified 5' or 3' UTR. For example, a microorganism can be engineered by genetic modification to express a nucleic acid reagent comprising a modified 5' or 3' UTR that can add a novel activity (e.g., an activity not normally found in the host organism) or increase the expression of an existing activity by increasing transcription from a homologous or heterologous promoter operably linked to a nucleotide sequence of interest (e.g., homologous or heterologous nucleotide sequence of interest), in certain embodiments. In some embodiments, a microorganism can be engineered by genetic modification to express a nucleic acid reagent comprising a modified 5' or 3' UTR that can decrease the expression of an activity by decreasing or substantially eliminating transcription from a homologous or heterologous promoter operably linked to a nucleotide sequence of interest, in certain embodiments.

Target Nucleotide Sequence

A nucleotide reagent sometimes can comprise a target nucleotide sequence. A "target nucleotide sequence" as used herein encodes a nucleic acid, peptide, polypeptide or protein of interest, and may be a ribonucleotide sequence or a deoxyribonucleotide sequence. A target nucleic acid sometimes is an untranslated ribonucleic acid and sometimes is a translated ribonucleic acid. An untranslated ribonucleic acid may include, but is not limited to, a small interfering ribonucleic acid (siRNA), a short hairpin ribonucleic acid (shRNA), other ribonucleic acid capable of RNA interference (RNAi), an antisense ribonucleic acid, or a ribozyme. A translatable target nucleotide sequence (e.g., a target ribonucleotide sequence) sometimes encodes a peptide, polypeptide or protein, which are sometimes referred to herein as "target peptides," "target polypeptides" or "target proteins".

Any peptides, polypeptides or proteins, or an activity catalyzed by one or more peptides, polypeptides or proteins may be encoded by a target nucleotide sequence and may be selected by a user. Representative proteins include enzymes (e.g., acetyl-CoA carboxylase, acyl-CoA oxidase, thioesterase, monooxygenase, monooxygenase reductase, fatty alcohol oxidase, acyltransferase and the like, for example), antibodies, serum proteins (e.g., albumin), membrane bound proteins, hormones (e.g., growth hormone, erythropoietin, insulin, etc.), cytokines, etc., and include both naturally occurring and exogenously expressed polypeptides. Representative activities (e.g., enzymes or combinations of enzymes which are functionally associated to provide an activity) include thioesterase activity, monooxygenase activity, monooxygenase reductase activity, acyltransferase activity, omega hydroxyl fatty acid dehydrogenase activity, beta-oxidation activity, omega-oxidation activity and the like, for example. The term "enzyme" as used herein refers to a protein which can act as a catalyst to induce a chemical change in other compounds, thereby producing one or more products from one or more substrates.

Specific polypeptides (e.g., enzymes) useful for embodiments described herein are listed herein. The term "protein" as used herein refers to a molecule having a sequence of amino acids linked by peptide bonds. This term includes fusion proteins, oligopeptides, peptides, cyclic peptides, polypeptides and polypeptide derivatives, whether native or recombinant, and also includes fragments, derivatives, homologs, and variants thereof. A protein or polypeptide sometimes is of intracellular origin (e.g., located in the nucleus, cytosol, or interstitial space of host cells in vivo) and sometimes is a cell membrane protein in vivo. In some embodiments (described above, and in further detail hereafter in Engineering and Alteration Methods), a genetic modification can result in a modification (e.g., increase, substantially increase, decrease or substantially decrease) of a target activity.

A translatable nucleotide sequence generally is located between a start codon (AUG in ribonucleic acids and ATG in deoxyribonucleic acids) and a stop codon (e.g., UAA (ochre), UAG (amber) or UGA (opal) in ribonucleic acids and TAA, TAG or TGA in deoxyribonucleic acids), and sometimes is referred to herein as an "open reading frame" (ORF). A translatable nucleotide sequence (e.g., ORF) sometimes is encoded differently in one organism (e.g., most organisms encode CTG as leucine) than in another organism (e.g., *C. tropicalis* encodes CTG as serine). In some embodiments, a translatable nucleotide sequence is altered to correct alternate genetic code (e.g., codon usage) differences between a nucleotide donor organism and an nucleotide recipient organism (e.g., engineered organism). In certain embodiments, a translatable nucleotide sequence is altered to improve; (i) codon usage, (ii) transcriptional efficiency, (iii) translational efficiency, (iv) the like, and combinations thereof.

Nucleic Acid Reagents & Tools

A nucleic acid reagent sometimes comprises one or more ORFs. An ORF may be from any suitable source, sometimes from genomic DNA, mRNA, reverse transcribed RNA or complementary DNA (cDNA) or a nucleic acid library comprising one or more of the foregoing, and is from any organism species that contains a nucleic acid sequence of interest, protein of interest, or activity of interest. Non-limiting examples of organisms from which an ORF can be obtained include bacteria, yeast, fungi, human, insect, nematode, bovine, equine, canine, feline, rat or mouse, for example.

A nucleic acid reagent sometimes comprises a nucleotide sequence adjacent to an ORF that is translated in conjunction with the ORF and encodes an amino acid tag. The tag-encoding nucleotide sequence is located 3' and/or 5' of an ORF in the nucleic acid reagent, thereby encoding a tag at the C-terminus or N-terminus of the protein or peptide encoded by the ORF. Any tag that does not abrogate in vitro transcription and/or translation may be utilized and may be appropriately selected by the artisan. Tags may facilitate isolation and/or purification of the desired ORF product from culture or fermentation media.

A tag sometimes specifically binds a molecule or moiety of a solid phase or a detectable label, for example, thereby having utility for isolating, purifying and/or detecting a protein or peptide encoded by the ORF. In some embodiments, a tag comprises one or more of the following elements: FLAG (e.g., DYKDDDDKG) (SEQ ID NO: 205), V5 (e.g., GKPIPNPLLGLDST) (SEQ ID NO: 206), c-MYC (e.g., EQKLISEEDL) (SEQ ID NO: 207), HSV (e.g., QPELAPEDPED) (SEQ ID NO: 208), influenza hemaglutinin, HA (e.g., YPYDVPDYA) (SEQ ID NO: 209), VSV-G (e.g., YTDIEMNRLGK) (SEQ ID NO: 210), bacterial glutathione-S-transferase, maltose binding protein, a streptavidin- or avidin-binding tag (e.g., pcDNA™6 BioEase™ Gateway® Biotinylation System (Invitrogen)), thioredoxin, β-galactosidase, VSV-glycoprotein, a fluorescent protein (e.g., green fluorescent protein or one of its many color variants (e.g., yellow, red, blue)), a polylysine or polyarginine sequence, a polyhistidine sequence (e.g., His6) (SEQ ID NO: 211) or other sequence that chelates a metal (e.g., cobalt, zinc, copper), and/or a cysteine-rich sequence that binds to an arsenic-containing molecule. In certain embodiments, a cysteine-rich tag comprises the amino acid sequence CC-Xn-CC (SEQ ID NO: 212), wherein X is any amino acid and n is 1 to 3, and the cysteine-rich sequence sometimes is CCPGCC (SEQ ID NO: 213). In certain embodiments, the tag comprises a cysteine-rich element and a polyhistidine element (e.g., CCPGCC (SEQ ID NO: 213) and His6 (SEQ ID NO: 211)).

A tag often conveniently binds to a binding partner. For example, some tags bind to an antibody (e.g., FLAG) and sometimes specifically bind to a small molecule. For example, a polyhistidine tag specifically chelates a bivalent metal, such as copper, zinc and cobalt; a polylysine or polyarginine tag specifically binds to a zinc finger; a glutathione S-transferase tag binds to glutathione; and a cysteine-rich tag specifically binds to an arsenic-containing molecule. Arsenic-containing molecules include LUMIO™ agents (Invitrogen, California), such as FlAsH™ (EDT2[4',5'-bis(1,3,2-dithioarsolan-2-yl)fluorescein-(1,2-ethanedithiol)2]) and ReAsH reagents (e.g., U.S. Pat. No. 5,932,474 to Tsien et al., entitled "Target Sequences for Synthetic Molecules;" U.S. Pat. No. 6,054,271 to Tsien et al., entitled "Methods of Using Synthetic Molecules and Target Sequences;" U.S. Pat. Nos. 6,451,569 and 6,008,378; published U.S. Patent Application 2003/0083373, and published PCT Patent Application WO 99/21013, all to Tsien et al. and all entitled "Synthetic Molecules that Specifically React with Target Sequences"). Such antibodies and small molecules sometimes are linked to a solid phase for convenient isolation of the target protein or target peptide.

A tag sometimes comprises a sequence that localizes a translated protein or peptide to a component in a system, which is referred to as a "signal sequence" or "localization signal sequence" herein. A signal sequence often is incorporated at the N-terminus of a target protein or target peptide, and sometimes is incorporated at the C-terminus Examples of signal sequences are known to the artisan, are readily incorporated into a nucleic acid reagent, and often are selected according to the organism in which expression of the nucleic acid reagent is performed. A signal sequence in some embodiments localizes a translated protein or peptide to a cell membrane. Examples of signal sequences include, but are not limited to, a nucleus targeting signal (e.g., steroid receptor sequence and N-terminal sequence of SV40 virus large T antigen); mitochondrial targeting signal (e.g., amino acid sequence that forms an amphipathic helix); peroxisome targeting signal (e.g., C-terminal sequence in YFG from *S. cerevisiae*); and a secretion signal (e.g., N-terminal sequences from invertase, mating factor alpha, PHO5 and SUC2 in *S. cerevisiae*; multiple N-terminal sequences of *B. subtilis* proteins (e.g., Tjalsma et al., Microbiol. Molec. Biol. Rev. 64: 515-547 (2000)); alpha amylase signal sequence (e.g., U.S. Pat. No. 6,288,302); pectate lyase signal sequence (e.g., U.S. Pat. No. 5,846,818); precollagen signal sequence (e.g., U.S. Pat. No. 5,712,114); OmpA signal sequence (e.g., U.S. Pat. No. 5,470,719); lam beta signal sequence (e.g., U.S. Pat. No. 5,389,529); *B. brevis* signal sequence (e.g., U.S. Pat. No. 5,232,841); and *P. pastoris* signal sequence (e.g., U.S. Pat. No. 5,268,273)).

A tag sometimes is directly adjacent to the amino acid sequence encoded by an ORF (i.e., there is no intervening sequence) and sometimes a tag is substantially adjacent to an ORF encoded amino acid sequence (e.g., an intervening sequence is present). An intervening sequence sometimes includes a recognition site for a protease, which is useful for cleaving a tag from a target protein or peptide. In some embodiments, the intervening sequence is cleaved by Factor Xa (e.g., recognition site I (E/D)GR), thrombin (e.g., recognition site LVPRGS (SEQ ID NO: 214)), enterokinase (e.g., recognition site DDDDK (SEQ ID NO: 215)), TEV protease (e.g., recognition site ENLYFQG (SEQ ID NO: 216)) or PreScission™ protease (e.g., recognition site LEVLFQGP (SEQ ID NO: 217)), for example.

An intervening sequence sometimes is referred to herein as a "linker sequence," and may be of any suitable length selected by the artisan. A linker sequence sometimes is about 1 to about 20 amino acids in length, and sometimes about 5 to about 10 amino acids in length. The artisan may select the linker length to substantially preserve target protein or peptide function (e.g., a tag may reduce target protein or peptide function unless separated by a linker), to enhance disassociation of a tag from a target protein or peptide when a protease cleavage site is present (e.g., cleavage may be enhanced when a linker is present), and to enhance interaction of a tag/target protein product with a solid phase. A linker can be of any suitable amino acid content, and often comprises a higher proportion of amino acids having relatively short side chains (e.g., glycine, alanine, serine and threonine).

A nucleic acid reagent sometimes includes a stop codon between a tag element and an insertion element or ORF, which can be useful for translating an ORF with or without the tag. Mutant tRNA molecules that recognize stop codons (described above) suppress translation termination and thereby are designated "suppressor tRNAs." Suppressor tRNAs can result in the insertion of amino acids and continuation of translation past stop codons (e.g., U.S. Patent Application No. 60/587,583, filed Jul. 14, 2004, entitled "Production of Fusion Proteins by Cell-Free Protein Synthesis,"; Eggertsson, et al., (1988) Microbiological Review 52(3):354-374, and Engleerg-Kukla, et al. (1996) in *Escherichia coli* and *Salmonella* Cellular and Molecular Biology, Chapter 60, pps 909-921, Neidhardt, et al. eds., ASM Press, Washington, D.C.). A number of suppressor tRNAs are known, including but not limited to, supE, supP, supD, supF and supZ suppressors, which suppress the termination of translation of the amber stop codon; supB, glT, supL, supN, supC and supM suppressors, which suppress the function of the ochre stop codon and glyT, trpT and Su-9 suppressors, which suppress the function of the opal stop codon. In general, suppressor tRNAs contain one or more mutations in the anti-codon loop of the tRNA that allows the tRNA to base pair with a codon that ordinarily functions as a stop codon. The mutant tRNA is charged with its cognate amino acid residue and the cognate amino acid residue is inserted into the translating polypeptide when the stop codon is encountered. Mutations that enhance the efficiency of termination suppressors (i.e., increase stop codon read-through) have been identified. These include, but are not limited to, mutations in the uar gene (also known as the prfA gene), mutations in the ups gene, mutations in the sueA, sueB and sueC genes, mutations in the rpsD (ramA) and rpsE (spcA) genes and mutations in the rplL gene.

Thus, a nucleic acid reagent comprising a stop codon located between an ORF and a tag can yield a translated ORF alone when no suppressor tRNA is present in the translation system, and can yield a translated ORF-tag fusion when a suppressor tRNA is present in the system. Suppressor tRNA can be generated in cells transfected with a nucleic acid encoding the tRNA (e.g., a replication incompetent adenovirus containing the human tRNA-Ser suppressor gene can be transfected into cells, or a YAC containing a yeast or bacterial tRNA suppressor gene can be transfected into yeast cells, for example). Vectors for synthesizing suppressor tRNA and for translating ORFs with or without a tag are available to the artisan (e.g., Tag-On-Demand™ kit (Invitrogen Corporation, California); Tag-On-Demand™ Suppressor Supernatant Instruction Manual, Version B, 6 Jun. 2003; Tag-On-Demand™ Gateway® Vector Instruction Manual, Version B, 20 June; and Capone et al., Amber, ochre and opal suppressor tRNA genes derived from a human serine tRNA gene. EMBO J. 4:213, 1985).

Any convenient cloning strategy known in the art may be utilized to incorporate an element, such as an ORF, into a nucleic acid reagent. Known methods can be utilized to insert an element into the template independent of an insertion element, such as (1) cleaving the template at one or more existing restriction enzyme sites and ligating an element of interest and (2) adding restriction enzyme sites to the template by hybridizing oligonucleotide primers that include one or more suitable restriction enzyme sites and amplifying by polymerase chain reaction (described in greater detail herein). Other cloning strategies take advantage of one or more insertion sites present or inserted into the nucleic acid reagent, such as an oligonucleotide primer hybridization site for PCR, for example, and others described herein. In some embodiments, a cloning strategy can be combined with genetic manipulation such as recombination (e.g., recombination of a nucleic acid reagent with a nucleic acid sequence of interest into the genome of the organism to be modified, as described further herein). In some embodiments, the cloned ORF(s) can produce (directly or indirectly) a fatty dicarboxylic acid (e.g., octanedioic acid, decanedioic acid, dodecanedioic acid, tetradecanedioic acid, hexadecanedioic acid, octadecanedioic acid, eicosanedioic acid), by engineering a microorganism with one or more ORFs of interest, which microorganism comprises one or more altered activities selected from the group consisting of omega hydroxyl fatty acid dehydrogenase activity, acyl-CoA oxidase activity, acyltransferase activity, thioesterase activity, monooxygenase activity and monooxygenase reductase activity.

In some embodiments, the nucleic acid reagent includes one or more recombinase insertion sites. A recombinase insertion site is a recognition sequence on a nucleic acid molecule that participates in an integration/recombination reaction by recombination proteins. For example, the recombination site for Cre recombinase is loxP, which is a 34 base pair sequence comprised of two 13 base pair inverted repeats (serving as the recombinase binding sites) flanking an 8 base pair core sequence (e.g., FIG. 1 of Sauer, B., Curr. Opin. Biotech. 5:521-527 (1994)). Other examples of recombination sites include attB, attP, attL, and attR sequences, and mutants, fragments, variants and derivatives thereof, which are recognized by the recombination protein λ Int and by the auxiliary proteins integration host factor (IHF), FIS and excisionase (Xis) (e.g., U.S. Pat. Nos. 5,888,732; 6,143,557; 6,171,861; 6,270,969; 6,277,608; and 6,720,140; U.S. patent application Ser. No. 09/517,466, filed Mar. 2, 2000, and Ser. No. 09/732,914, filed Aug. 14, 2003, and in U.S. patent publication no. 2002-0007051-A1; Landy, Curr. Opin. Biotech. 3:699-707 (1993)).

Examples of recombinase cloning nucleic acids are in Gateway® systems (Invitrogen, California), which include at least one recombination site for cloning a desired nucleic acid molecules in vivo or in vitro. In some embodiments, the system utilizes vectors that contain at least two different site-specific recombination sites, often based on the bacteriophage lambda system (e.g., att1 and att2), and are mutated from the wild-type (att0) sites. Each mutated site has a unique specificity for its cognate partner att site (i.e., its binding partner recombination site) of the same type (for example attB1 with attP1, or attL1 with attR1) and will not cross-react with recombination sites of the other mutant type or with the wild-type att0 site. Different site specificities allow directional cloning or linkage of desired molecules thus providing desired orientation of the cloned molecules. Nucleic acid fragments flanked by recombination sites are cloned and subcloned using the Gateway® system by replacing a selectable marker (for example, ccdB) flanked by att sites on the recipient plasmid molecule, sometimes termed the Destination Vector. Desired clones are then selected by transformation of a ccdB sensitive host strain and positive selection for a marker on the recipient molecule. Similar strategies for negative selection (e.g., use of toxic genes) can be used in other organisms such as thymidine kinase (TK) in mammals and insects.

A recombination system useful for engineering yeast is outlined briefly. The system makes use of the URA3 gene (e.g., for *S. cerevisieae* and *C. albicans*, for example) or URA4 and URA5 genes (e.g., for *S. pombe*, for example) and toxicity of the nucleotide analogue 5-Fluoroorotic acid (5-FOA). The URA3 or URA4 and URA5 genes encode orotine-5'-monophosphate (OMP) dicarboxylase. Yeast with an active URA3 or URA4 and URA5 gene (phenotypically Ura+) convert 5-FOA to fluorodeoxyuridine, which is toxic to yeast cells. Yeast carrying a mutation in the appropriate gene(s) or having a knock out of the appropriate gene(s) can grow in the presence of 5-FOA, if the media is also supplemented with uracil.

A nucleic acid engineering construct can be made which may comprise the URA3 gene or cassette (for *S. cerevisieae*), flanked on either side by the same nucleotide sequence in the same orientation. The URA3 cassette comprises a promoter, the URA3 gene and a functional transcription terminator. Target sequences which direct the construct to a particular nucleic acid region of interest in the organism to be engineered are added such that the target sequences are adjacent to and abut the flanking sequences on either side of the URA3 cassette. Yeast can be transformed with the engineering construct and plated on minimal media without uracil. Colonies can be screened by PCR to determine those transformants that have the engineering construct inserted in the proper location in the genome. Checking insertion location prior to selecting for recombination of the ura3 cassette may reduce the number of incorrect clones carried through to later stages of the procedure. Correctly inserted transformants can then be replica plated on minimal media containing 5-FOA to select for recombination of the URA3 cassette out of the construct, leaving a disrupted gene and an identifiable footprint (e.g., nucleic acid sequence) that can be use to verify the presence of the disrupted gene. The technique described is useful for disrupting or "knocking out" gene function, but also can be used to insert genes or constructs into a host organisms genome in a targeted, sequence specific manner.

In certain embodiments, a nucleic acid reagent includes one or more topoisomerase insertion sites. A topoisomerase insertion site is a defined nucleotide sequence recognized and bound by a site-specific topoisomerase. For example, the nucleotide sequence 5'-(C/T)CCTT-3' is a topoisomerase recognition site bound specifically by most poxvirus topoisomerases, including vaccinia virus DNA topoisomerase I. After binding to the recognition sequence, the topoisomerase cleaves the strand at the 3'-most thymidine of the recognition site to produce a nucleotide sequence comprising 5'-(C/T)CCTT-PO4-TOPO, a complex of the topoisomerase covalently bound to the 3' phosphate via a tyrosine in the topoisomerase (e.g., Shuman, J. Biol. Chem. 266: 11372-11379, 1991; Sekiguchi and Shuman, Nucl. Acids Res. 22:5360-5365, 1994; U.S. Pat. No. 5,766,891; PCT/US95/16099; and PCT/US98/12372). In comparison, the nucleotide sequence 5'-GCAACTT-3' is a topoisomerase recognition site for type IA *E. coli* topoisomerase III. An element to be inserted often is combined with topoisomerase-reacted template and thereby incorporated into the nucleic acid reagent.

A nucleic acid reagent sometimes contains one or more origin of replication (ORI) elements. In some embodiments, a template comprises two or more ORIs, where one functions efficiently in one organism (e.g., a bacterium) and another functions efficiently in another organism (e.g., a eukaryote, like yeast for example). In some embodiments, an ORI may function efficiently in one species (e.g., *S. cerevisieae*, for example) and another ORI may function efficiently in a different species (e.g., *S. pombe*, for example). A nucleic acid reagent also sometimes includes one or more transcription regulation sites.

A nucleic acid reagent can include one or more selection elements (e.g., elements for selection of the presence of the nucleic acid reagent, and not for activation of a promoter element which can be selectively regulated). Selection elements often are utilized using known processes to determine whether a nucleic acid reagent is included in a cell. In some embodiments, a nucleic acid reagent includes two or more selection elements, where one functions efficiently in one organism and another functions efficiently in another organism. Examples of selection elements include, but are not limited to, (1) nucleic acid segments that encode products that provide resistance against otherwise toxic compounds (e.g., antibiotics); (2) nucleic acid segments that encode products that are otherwise lacking in the recipient cell (e.g., essential products, tRNA genes, auxotrophic markers); (3) nucleic acid segments that encode products that suppress the activity of a gene product; (4) nucleic acid segments that encode products that can be readily identified (e.g., phenotypic markers such as antibiotics (e.g., β-lactamase), β-galactosidase, green fluorescent protein (GFP), yellow fluorescent protein (YFP), red fluorescent protein (RFP), cyan fluorescent protein (CFP), and cell surface proteins); (5) nucleic acid segments that bind products that are otherwise detrimental to cell survival and/or function; (6) nucleic acid segments that otherwise inhibit the activity of any of the nucleic acid segments described in Nos. 1-5 above (e.g., antisense oligonucleotides); (7) nucleic acid segments that bind products that modify a substrate (e.g., restriction endonucleases); (8) nucleic acid segments that can be used to isolate or identify a desired molecule (e.g., specific protein binding sites); (9) nucleic acid segments that encode a specific nucleotide sequence that can be otherwise non-functional (e.g., for PCR amplification of subpopulations of molecules); (10) nucleic acid segments that, when absent, directly or indirectly confer resistance or sensitivity to particular compounds; (11) nucleic acid segments that encode products that either are toxic or convert a relatively non-toxic compound to a toxic compound (e.g., Herpes simplex thymidine kinase, cytosine deaminase) in recipient cells; (12) nucleic acid segments that inhibit replication, partition or heritability of nucleic acid molecules that contain them; and/or (13) nucleic acid segments that encode conditional replication functions, e.g., replication in certain hosts or host cell strains or under certain environmental conditions (e.g., temperature, nutritional conditions, and the like).

A nucleic acid reagent is of any form useful for in vivo transcription and/or translation. A nucleic acid sometimes is a plasmid, such as a supercoiled plasmid, sometimes is a yeast artificial chromosome (e.g., YAC), sometimes is a linear nucleic acid (e.g., a linear nucleic acid produced by PCR or by restriction digest), sometimes is single-stranded and sometimes is double-stranded. A nucleic acid reagent sometimes is prepared by an amplification process, such as a polymerase chain reaction (PCR) process or transcription-mediated amplification process (TMA). In TMA, two enzymes are used in an isothermal reaction to produce amplification products detected by light emission (see, e.g., Biochemistry 1996 Jun. 25; 35(25):8429-38). Standard PCR processes are known (e.g., U.S. Pat. Nos. 4,683,202; 4,683, 195; 4,965,188; and 5,656,493), and generally are performed in cycles. Each cycle includes heat denaturation, in which hybrid nucleic acids dissociate; cooling, in which primer oligonucleotides hybridize; and extension of the oligonucleotides by a polymerase (i.e., Taq polymerase). An example of a PCR cyclical process is treating the sample at 95° C. for 5 minutes; repeating forty-five cycles of 95° C. for 1 minute, 59° C. for 1 minute, 10 seconds, and 72° C. for 1 minute 30 seconds; and then treating the sample at 72° C. for 5 minutes. Multiple cycles frequently are performed using a commercially available thermal cycler. PCR amplification products sometimes are stored for a time at a lower temperature (e.g., at 4° C.) and sometimes are frozen (e.g., at −20° C.) before analysis.

In some embodiments, a nucleic acid reagent, protein reagent, protein fragment reagent or other reagent described herein is isolated or purified. The term "isolated" as used herein refers to material removed from its original environment (e.g., the natural environment if it is naturally occurring, or a host cell if expressed exogenously), and thus is altered "by the hand of man" from its original environment. The term "purified" as used herein with reference to molecules does not refer to absolute purity. Rather, "purified" refers to a substance in a composition that contains fewer substance species in the same class (e.g., nucleic acid or protein species) other than the substance of interest in comparison to the sample from which it originated. "Purified," if a nucleic acid or protein for example, refers to a substance in a composition that contains fewer nucleic acid species or protein species other than the nucleic acid or protein of interest in comparison to the sample from which it originated. Sometimes, a protein or nucleic acid is "substantially pure," indicating that the protein or nucleic acid represents at least 50% of protein or nucleic acid on a mass basis of the composition. Often, a substantially pure protein or nucleic acid is at least 75% on a mass basis of the composition, and sometimes at least 95% on a mass basis of the composition.

Engineering and Alteration Methods

Methods and compositions (e.g., nucleic acid reagents) described herein can be used to generate engineered microorganisms. As noted above, the term "engineered microorganism" as used herein refers to a modified organism that includes one or more activities distinct from an activity present in a microorganism utilized as a starting point for modification (e.g., host microorganism or unmodified organism). Engineered microorganisms typically arise as a result of a genetic modification, usually introduced or selected for, by one of skill in the art using readily available techniques. Non-limiting examples of methods useful for generating an altered activity include, introducing a heterologous polynucleotide (e.g., nucleic acid or gene integration, also referred to as "knock in"), removing an endogenous polynucleotide, altering the sequence of an existing endogenous nucleic acid sequence (e.g., site-directed mutagenesis), disruption of an existing endogenous nucleic acid sequence (e.g., knock outs and transposon or insertion element mediated mutagenesis), selection for an altered activity where the selection causes a change in a naturally occurring activity that can be stably inherited (e.g., causes a change in a nucleic acid sequence in the genome of the organism or in an epigenetic nucleic acid that is replicated and passed on to daughter cells), PCR-based mutagenesis, and the like. The term "mutagenesis" as used herein refers to any modification to a nucleic acid (e.g., nucleic acid reagent, or host chromosome, for example) that is subsequently used to generate a product in a host or modified organism. Non-limiting examples of mutagenesis include deletion, insertion, substitution, rearrangement, point mutations, suppressor mutations and the like. Mutagenesis methods are known in the art and are readily available to the artisan. Non-limiting examples of mutagenesis methods are described herein and can also be found in Maniatis, T., E. F. Fritsch and J. Sambrook (1982) Molecular Cloning: a Laboratory Manual; Cold Spring Harbor Laboratory, Cold Spring Harbor, N.Y. Another non-limiting example of mutagenesis can be conducted using a Stratagene (San Diego, Calif.) "Quick-Change" kit according to the manufacturer's instructions.

The term "genetic modification" as used herein refers to any suitable nucleic acid addition, removal or alteration that facilitates production of a target fatty dicarboxylic acid product (e.g., sebacic or dodecanedioic acid) in an engineered microorganism. Genetic modifications include, without limitation, insertion of one or more nucleotides in a native nucleic acid of a host organism in one or more locations, deletion of one or more nucleotides in a native nucleic acid of a host organism in one or more locations, modification or substitution of one or more nucleotides in a native nucleic acid of a host organism in one or more locations, insertion of a non-native nucleic acid into a host organism (e.g., insertion of an autonomously replicating vector), and removal of a non-native nucleic acid in a host organism (e.g., removal of a vector).

The term "heterologous polynucleotide" as used herein refers to a nucleotide sequence not present in a host microorganism in some embodiments. In certain embodiments, a heterologous polynucleotide is present in a different amount (e.g., different copy number) than in a host microorganism, which can be accomplished, for example, by introducing more copies of a particular nucleotide sequence to a host microorganism (e.g., the particular nucleotide sequence may be in a nucleic acid autonomous of the host chromosome or may be inserted into a chromosome). A heterologous polynucleotide is from a different organism in some embodiments, and in certain embodiments, is from the same type of organism but from an outside source (e.g., a recombinant source).

In some embodiments, an organism engineered using the methods and nucleic acid reagents described herein can produce a fatty dicarboxylic acid (e.g., octanedioic acid, decanedioic acid, dodecanedioic acid, tetradecanedioic acid, hexadecanedioic acid, octadecanedioic acid, eicosanedioic acid). In certain embodiments, an engineered microorganism described herein that produces a fatty dicarboxylic acid (e.g., octanedioic acid, decanedioic acid, dodecanedioic acid, tetradecanedioic acid, hexadecanedioic acid, octadecanedioic acid, eicosanedioic acid) may comprise one ore more altered activities selected from the group consisting of omega oxo fatty acid dehydrogenase activity, omega hydroxyl fatty acid dehydrogenase activity, fatty acid synthase activity, acetyl CoA carboxylase activity, acyl-CoA oxidase activity, monooxygenase activity and monooxygenase reductase activity. In some embodiments, an engineered microorganism as described herein may comprise a genetic modification that adds or increases the omega oxo fatty acid dehydrogenase activity, omega hydroxyl fatty acid dehydrogenase activity, fatty acid synthase activity, acetyl CoA carboxylase activity, acyl-CoA oxidase activity, monooxygenase activity and monooxygenase reductase activity.

In certain embodiments, an engineered microorganism described herein can comprise an altered thioesterase activity. In some embodiments, the engineered microorganism may comprise a genetic alteration that adds or increases a thioesterase activity. In some embodiments, the engineered microorganism comprising a genetic alteration that adds or increases a thioesterase activity, may further comprise a heterologous polynucleotide encoding a polypeptide having thioesterase activity.

The term "altered activity" as used herein refers to an activity in an engineered microorganism that is added or modified relative to the host microorganism (e.g., added, increased, reduced, inhibited or removed activity). An activity can be altered by introducing a genetic modification to a host microorganism that yields an engineered microorganism having added, increased, reduced, inhibited or removed activity.

An added activity often is an activity not detectable in a host microorganism. An increased activity generally is an activity detectable in a host microorganism that has been increased in an engineered microorganism. An activity can be increased to any suitable level for production of a target fatty dicarboxylic acid product (e.g., sebacic or dodecanedioic acid), including but not limited to less than 2-fold (e.g., about 10% increase to about 99% increase; about 20%, 30%, 40%, 50%, 60%, 70%, 80%, 90% increase), 2-fold, 3-fold, 4-fold, 5-fold, 6-fold, 7-fold, 8-fold, 9-fold, of 10-fold increase, or greater than about 10-fold increase. A reduced or inhibited activity generally is an activity detectable in a host microorganism that has been reduced or inhibited in an engineered microorganism. An activity can be reduced to undetectable levels in some embodiments, or detectable levels in certain embodiments. An activity can be decreased to any suitable level for production of a target fatty dicarboxylic acid product (e.g., sebacic or dodecanedioic acid), including but not limited to less than 2-fold (e.g., about 10% decrease to about 99% decrease; about 20%, 30%, 40%, 50%, 60%, 70%, 80%, 90% decrease), 2-fold, 3-fold, 4-fold, 5-fold, 6-fold, 7-fold, 8-fold, 9-fold, of 10-fold decrease, or greater than about 10-fold decrease.

An altered activity sometimes is an activity not detectable in a host organism and is added to an engineered organism. An altered activity also may be an activity detectable in a host organism and is increased in an engineered organism. An activity may be added or increased by increasing the number of copies of a polynucleotide that encodes a polypeptide having a target activity, in some embodiments. In some embodiments, the activity of a native polypeptide can be increased by increasing in the modified organism the number of copies of a polynucleotide that encodes the polypeptide (e.g., introducing 1 to about 100 additional copies of the polynucleotide (e.g., introducing 1, 2, 3, 4, 5, 6, 7, 8, 9, 10, 11, 12, 13, 14, 15, 16, 17, 18, 19, 20, 22, 24, 26, 28, 30 or more additional copies of the polynucleotide). In certain embodiments an activity can be added or increased by inserting into a host microorganism a polynucleotide that encodes a heterologous polypeptide having the added activity or encodes a modified endogenous polypeptide. In such embodiments, 1 to about 100 copies of the polynucleotide can be introduced (e.g., introducing 1, 2, 3, 4, 5, 6, 7, 8, 9, 10, 11, 12, 13, 14, 15, 16, 17, 18, 19, 20, 22, 24, 26, 28, 30 copies). A "modified endogenous polypeptide" often has an activity different than an activity of a native polypeptide counterpart (e.g., different catalytic activity and/or different substrate specificity), and often is active (e.g., an activity (e.g., substrate turnover) is detectable). In certain embodiments, an activity can be added or increased by inserting into a host microorganism a heterologous polynucleotide that is (i) operably linked to another polynucleotide that encodes a polypeptide having the added activity, and (ii) up regulates production of the polynucleotide. Thus, an activity can be added or increased by inserting or modifying a regulatory polynucleotide operably linked to another polynucleotide that encodes a polypeptide having the target activity. In certain embodiments, an activity can be added or increased by subjecting a host microorganism to a selective environment and screening for microorganisms that have a detectable level of the target activity. Examples of a selective environment include, without limitation, a medium containing a substrate that a host organism can process and a medium lacking a substrate that a host organism can process.

An altered activity sometimes is an activity detectable in a host organism and is reduced, inhibited or removed (i.e., not detectable) in an engineered organism. An activity may be reduced or removed by decreasing the number of copies of a polynucleotide that encodes a polypeptide having a target activity, in some embodiments. In some embodiments, an activity can be reduced or removed by (i) inserting a polynucleotide within a polynucleotide that encodes a polypeptide having the target activity (disruptive insertion), and/or (ii) removing a portion of or all of a polynucleotide that encodes a polypeptide having the target activity (deletion or knock out, respectively). In certain embodiments, an activity can be reduced or removed by inserting into a host microorganism a heterologous polynucleotide that is (i) operably linked to another polynucleotide that encodes a polypeptide having the target activity, and (ii) down regulates production of the polynucleotide. Thus, an activity can be reduced or removed by inserting or modifying a regulatory polynucleotide operably linked to another polynucleotide that encodes a polypeptide having the target activity.

An activity also can be reduced or removed by (i) inhibiting a polynucleotide that encodes a polypeptide having the activity or (ii) inhibiting a polynucleotide operably linked to another polynucleotide that encodes a polypeptide having the activity. A polynucleotide can be inhibited by a suitable technique known in the art, such as by contacting an RNA encoded by the polynucleotide with a specific inhibitory RNA (e.g., RNAi, siRNA, ribozyme). An activity also can be reduced or removed by contacting a polypeptide having the activity with a molecule that specifically inhibits the activity (e.g., enzyme inhibitor, antibody). In certain embodiments, an activity can be reduced or removed by subjecting a host microorganism to a selective environment and screening for microorganisms that have a reduced level or removal of the target activity.

In some embodiments, an untranslated ribonucleic acid, or a cDNA can be used to reduce the expression of a particular activity or enzyme. For example, a microorganism can be engineered by genetic modification to express a nucleic acid reagent that reduces the expression of an activity by producing an RNA molecule that is partially or substantially homologous to a nucleic acid sequence of interest which encodes the activity of interest. The RNA molecule can bind to the nucleic acid sequence of interest and inhibit the nucleic acid sequence from performing its natural function, in certain embodiments. In some embodiments, the RNA may alter the nucleic acid sequence of interest which encodes the activity of interest in a manner that the nucleic acid sequence of interest is no longer capable of performing its natural function (e.g., the action of a ribozyme for example).

In certain embodiments, nucleotide sequences sometimes are added to, modified or removed from one or more of the nucleic acid reagent elements, such as the promoter, 5'UTR, target sequence, or 3'UTR elements, to enhance, potentially enhance, reduce, or potentially reduce transcription and/or translation before or after such elements are incorporated in a nucleic acid reagent. In some embodiments, one or more of the following sequences may be modified or removed if they are present in a 5'UTR: a sequence that forms a stable secondary structure (e.g., quadruplex structure or stem loop stem structure (e.g., EMBL sequences X12949, AF274954, AF139980, AF152961, S95936, U194144, AF116649 or substantially identical sequences that form such stem loop stem structures)); a translation initiation codon upstream of the target nucleotide sequence start codon; a stop codon upstream of the target nucleotide sequence translation initiation codon; an ORF upstream of the target nucleotide sequence translation initiation codon; an iron responsive element (IRE) or like sequence; and a 5' terminal oligopyrimidine tract (TOP, e.g., consisting of 5-15 pyrimidines adjacent to the cap). A translational enhancer sequence and/or an internal ribosome entry site (IRES) sometimes is inserted into a 5'UTR (e.g., EMBL nucleotide sequences J04513, X87949, M95825, M12783, AF025841, AF013263, AF006822, M17169, M13440, M22427, D14838 and M17446 and substantially identical nucleotide sequences).

An AU-rich element (ARE, e.g., AUUUA repeats) and/or splicing junction that follows a non-sense codon sometimes is removed from or modified in a 3'UTR. A polyadenosine tail sometimes is inserted into a 3'UTR if none is present, sometimes is removed if it is present, and adenosine moieties sometimes are added to or removed from a polyadenosine tail present in a 3'UTR. Thus, some embodiments are directed to a process comprising: determining whether any nucleotide sequences that increase, potentially increase, reduce or potentially reduce translation efficiency are present in the elements, and adding, removing or modifying one or more of such sequences if they are identified. Certain embodiments are directed to a process comprising: determining whether any nucleotide sequences that increase or potentially increase translation efficiency are not present in the elements, and incorporating such sequences into the nucleic acid reagent.

In some embodiments, an activity can be altered by modifying the nucleotide sequence of an ORF. An ORF sometimes is mutated or modified (for example, by point mutation, deletion mutation, insertion mutation, PCR based mutagenesis and the like) to alter, enhance or increase, reduce, substantially reduce or eliminate the activity of the encoded protein or peptide. The protein or peptide encoded by a modified ORF sometimes is produced in a lower amount or may not be produced at detectable levels, and in other embodiments, the product or protein encoded by the modified ORF is produced at a higher level (e.g., codons sometimes are modified so they are compatible with tRNA's preferentially used in the host organism or engineered organism). To determine the relative activity, the activity from the product of the mutated ORF (or cell containing it) can be compared to the activity of the product or protein encoded by the unmodified ORF (or cell containing it).

In some embodiments, an ORF nucleotide sequence sometimes is mutated or modified to alter the triplet nucleotide sequences used to encode amino acids (e.g., amino acid codon triplets, for example). Modification of the nucleotide sequence of an ORF to alter codon triplets sometimes is used to change the codon found in the original sequence to better match the preferred codon usage of the organism in which the ORF or nucleic acid reagent will be expressed. The codon usage, and therefore the codon triplets encoded by a nucleic acid sequence, in bacteria may be different from the preferred codon usage in eukaryotes, like yeast or plants for example. Preferred codon usage also may be different between bacterial species. In certain embodiments an ORF nucleotide sequences sometimes is modified to eliminate codon pairs and/or eliminate mRNA secondary structures that can cause pauses during translation of the mRNA encoded by the ORF nucleotide sequence. Translational pausing sometimes occurs when nucleic acid secondary structures exist in an mRNA, and sometimes occurs due to the presence of codon pairs that slow the rate of translation by causing ribosomes to pause. In some embodiments, the use of lower abundance codon triplets can reduce translational pausing due to a decrease in the pause time needed to load a charged tRNA into the ribosome translation machinery. Therefore, to increase transcriptional and translational efficiency in bacteria (e.g., where transcription and translation are concurrent, for example) or to increase translational efficiency in eukaryotes (e.g., where transcription and translation are functionally separated), the nucleotide sequence of a nucleotide sequence of interest can be altered to better suit the transcription and/or translational machinery of the host and/or genetically modified microorganism. In certain embodiments, slowing the rate of translation by the use of lower abundance codons, which slow or pause the ribosome, can lead to higher yields of the desired product due to an increase in correctly folded proteins and a reduction in the formation of inclusion bodies.

Codons can be altered and optimized according to the preferred usage by a given organism by determining the codon distribution of the nucleotide sequence donor organism and comparing the distribution of codons to the distribution of codons in the recipient or host organism. Techniques described herein (e.g., site directed mutagenesis and the like) can then be used to alter the codons accordingly. Comparisons of codon usage can be done by hand or using nucleic acid analysis software commercially available to the artisan.

Modification of the nucleotide sequence of an ORF also can be used to correct codon triplet sequences that have diverged in different organisms. For example, certain yeast (e.g., *C. tropicalis* and *C. maltosa*) use the amino acid triplet CUG (e.g., CTG in the DNA sequence) to encode serine. CUG typically encodes leucine in most organisms. In order to maintain the correct amino acid in the resultant polypeptide or protein, the CUG codon must be altered to reflect the organism in which the nucleic acid reagent will be expressed. Thus, if an ORF from a bacterial donor is to be expressed in either *Candida* yeast strain mentioned above, the heterologous nucleotide sequence must first be altered or modified to the appropriate leucine codon. Therefore, in some embodiments, the nucleotide sequence of an ORF sometimes is altered or modified to correct for differences that have occurred in the evolution of the amino acid codon triplets between different organisms. In some embodiments, the nucleotide sequence can be left unchanged at a particular amino acid codon, if the amino acid encoded is a conservative or neutral change in amino acid when compared to the originally encoded amino acid.

In some embodiments, an activity can be altered by modifying translational regulation signals, like a stop codon for example. A stop codon at the end of an ORF sometimes is modified to another stop codon, such as an amber stop codon described above. In some embodiments, a stop codon is introduced within an ORF, sometimes by insertion or mutation of an existing codon. An ORF comprising a modified terminal stop codon and/or internal stop codon often is translated in a system comprising a suppressor tRNA that recognizes the stop codon. An ORF comprising a stop codon sometimes is translated in a system comprising a suppressor tRNA that incorporates an unnatural amino acid during translation of the target protein or target peptide.

Methods for incorporating unnatural amino acids into a target protein or peptide are known, which include, for example, processes utilizing a heterologous tRNA/synthetase pair, where the tRNA recognizes an amber stop codon and is loaded with an unnatural amino acid.

Depending on the portion of a nucleic acid reagent (e.g., Promoter, 5' or 3' UTR, ORI, ORF, and the like) chosen for alteration (e.g., by mutagenesis, introduction or deletion, for example) the modifications described above can alter a given activity by (i) increasing or decreasing feedback inhibition mechanisms, (ii) increasing or decreasing promoter initiation, (iii) increasing or decreasing translation initiation, (iv) increasing or decreasing translational efficiency, (v) modifying localization of peptides or products expressed from nucleic acid reagents described herein, or (vi) increasing or decreasing the copy number of a nucleotide sequence of interest, (vii) expression of an anti-sense RNA, RNAi, siRNA, ribozyme and the like. In some embodiments, alteration of a nucleic acid reagent or nucleotide sequence can alter a region involved in feedback inhibition (e.g., 5' UTR, promoter and the like). A modification sometimes is made that can add or enhance binding of a feedback regulator and sometimes a modification is made that can reduce, inhibit or eliminate binding of a feedback regulator.

In certain embodiments, alteration of a nucleic acid reagent or nucleotide sequence can alter sequences involved in transcription initiation (e.g., promoters, 5' UTR, and the like). A modification sometimes can be made that can enhance or increase initiation from an endogenous or heterologous promoter element. A modification sometimes can be made that removes or disrupts sequences that increase or enhance transcription initiation, resulting in a decrease or elimination of transcription from an endogenous or heterologous promoter element.

In some embodiments, alteration of a nucleic acid reagent or nucleotide sequence can alter sequences involved in translational initiation or translational efficiency (e.g., 5' UTR, 3' UTR, codon triplets of higher or lower abundance, translational terminator sequences and the like, for example). A modification sometimes can be made that can increase or decrease translational initiation, modifying a ribosome binding site for example. A modification sometimes can be made that can increase or decrease translational efficiency. Removing or adding sequences that form hairpins and changing codon triplets to a more or less preferred codon are non-limiting examples of genetic modifications that can be made to alter translation initiation and translation efficiency.

In certain embodiments, alteration of a nucleic acid reagent or nucleotide sequence can alter sequences involved in localization of peptides, proteins or other desired products (e.g., a sebacic acid or dodecanedioic acid, for example). A modification sometimes can be made that can alter, add or remove sequences responsible for targeting a polypeptide, protein or product to an intracellular organelle, the periplasm, cellular membranes, or extracellularly. Transport of a heterologous product to a different intracellular space or extracellularly sometimes can reduce or eliminate the formation of inclusion bodies (e.g., insoluble aggregates of the desired product).

In some embodiments, alteration of a nucleic acid reagent or nucleotide sequence can alter sequences involved in increasing or decreasing the copy number of a nucleotide sequence of interest. A modification sometimes can be made that increases or decreases the number of copies of an ORF stably integrated into the genome of an organism or on an epigenetic nucleic acid reagent. Non-limiting examples of alterations that can increase the number of copies of a sequence of interest include, adding copies of the sequence of interest by duplication of regions in the genome (e.g., adding additional copies by recombination or by causing gene amplification of the host genome, for example), cloning additional copies of a sequence onto a nucleic acid reagent, or altering an ORI to increase the number of copies of an epigenetic nucleic acid reagent. Non-limiting examples of alterations that can decrease the number of copies of a sequence of interest include, removing copies of the sequence of interest by deletion or disruption of regions in the genome, removing additional copies of the sequence from epigenetic nucleic acid reagents, or altering an ORI to decrease the number of copies of an epigenetic nucleic acid reagent.

In certain embodiments, increasing or decreasing the expression of a nucleotide sequence of interest can also be accomplished by altering, adding or removing sequences involved in the expression of an anti-sense RNA, RNAi, siRNA, ribozyme and the like. The methods described above can be used to modify expression of anti-sense RNA, RNAi, siRNA, ribozyme and the like.

The methods and nucleic acid reagents described herein can be used to generate genetically modified microorganisms with altered activities in cellular processes involved in a fatty dicarboxylic acid (e.g., octanedioic acid, decanedioic acid, dodecanedioic acid, tetradecanedioic acid, hexadecanedioic acid, octadecanedioic acid, eicosanedioic acid) synthesis. In some embodiments, an engineered microorganism described herein may comprise an increased number of copies of an endogenous polynucleotide encoding a polypeptide having omega oxo fatty acid dehydrogenase activity. In certain embodiments, an engineered microorganism described herein may comprise an increased number of copies of an endogenous polynucleotide encoding a polypeptide having omega hydroxyl fatty acid dehydrogenase activity. In some embodiments, an engineered microorganism described herein may comprise a heterologous polynucleotide encoding a polypeptide having omega oxo fatty acid dehydrogenase activity. In some embodiments, an engineered microorganism described herein may comprise a heterologous polynucleotide encoding a polypeptide having omega hydroxyl fatty acid dehydrogenase activity. In some embodiments, the heterologous polynucleotide can be from a bacterium. In some embodiments, the bacterium can be an *Acinetobacter*, *Nocardia*, *Pseudomonas* or *Xanthobacter* bacterium.

In some embodiments, an engineered microorganism described herein may comprise a heterologous polynucleotide encoding a polypeptide having monooxygenase activity. In certain embodiments, the heterologous polynucleotide can be from a bacterium. In some embodiments, the bacterium can be a *Bacillus* bacterium. In certain embodiments, the *Bacillus* bacterium is *B. megaterium*.

In certain embodiments, an engineered microorganism described herein may comprise a genetic modification that reduces omega hydroxyl fatty acid conversion. In some embodiments, the genetic modification can reduce omega hydroxyl fatty acid dehydrogenase activity. In certain embodiments, an engineered microorganism described herein may comprise a genetic modification that reduces beta-oxidation activity. In some embodiments, the genetic modification can reduce a target activity described herein.

Engineered microorganisms that produce a fatty dicarboxylic acid (e.g., octanedioic acid, decanedioic acid, dodecanedioic acid, tetradecanedioic acid, hexadecanedioic acid, octadecanedioic acid, eicosanedioic acid), as described herein, can comprise an altered monooxygenase activity, in certain embodiments. In some embodiments, the engineered microorganism described herein may comprise a genetic modification that alters the monooxygenase activity. In certain embodiments, the engineered microorganism described herein can comprise an increase number of copies of an endogenous polynucleotide encoding a polypeptide having monooxygenase activity. In some embodiments, the engineered microorganism described herein can comprise a heterologous polynucleotide encoding a polypeptide having monooxygenase activity. In certain embodiments, the heterologous polynucleotide can be from a bacterium. In some embodiments, the bacterium can be a *Bacillus* bacterium. In certain embodiments, the *Bacillus* bacterium is *B. megaterium*. In some embodiments, the genetic modification can reduce a polyketide synthase activity.

Engineered microorganisms that produce a fatty dicarboxylic acid (e.g., octanedioic acid, decanedioic acid, dodecanedioic acid, tetradecanedioic acid, hexadecanedioic acid, octadecanedioic acid, eicosanedioic acid), as described herein, can comprise an altered thioesterase activity, in certain embodiments. In some embodiments, the engineered microorganism may comprise a genetic modification that adds or increases the thioesterase activity. In certain embodiments, the engineered microorganism may comprise a heterologous polynucleotide encoding a polypeptide having thioesterase activity.

In some embodiments, the engineered microorganism with an altered thioesterase activity may comprise an altered omega oxo fatty acid dehydrogenase activity. In certain embodiments, the engineered microorganism with an altered thioesterase activity may comprise a genetic modification that adds or increases omega oxo fatty acid dehydrogenase activity. In some embodiments, the engineered microorganism may comprise a heterologous polynucleotide encoding a polypeptide having altered omega oxo fatty acid dehydrogenase activity. In certain embodiments, the heterologous polynucleotide can be from a bacterium. In some embodiments, the bacterium can be an *Acinetobacter, Nocardia, Pseudomonas* or *Xanthobacter* bacterium.

Engineered microorganisms that produce a fatty dicarboxylic acid (e.g., octanedioic acid, decanedioic acid, dodecanedioic acid, tetradecanedioic acid, hexadecanedioic acid, octadecanedioic acid, eicosanedioic acid), as described herein, can comprise an altered omega hydroxyl fatty acid dehydrogenase activity. In certain embodiments, the engineered microorganism may comprise a genetic modification that adds or increases the omega hydroxyl fatty acid dehydrogenase activity. In certain embodiments, the engineered microorganism may comprise a heterologous polynucleotide encoding a polypeptide having altered omega hydroxyl fatty acid dehydrogenase activity. In some embodiments, the heterologous polynucleotide is from a bacterium. In certain embodiments, the bacterium can be an *Acinetobacter, Nocardia, Pseudomonas* or *Xanthobacter* bacterium. In some embodiments, the engineered microorganism can be a eukaryote. In certain embodiments, the eukaryote can be a yeast. In some embodiments, the eukaryote may be a fungus. In certain embodiments, the yeast can be a *Candida* yeast. In some embodiments, the *Candida* yeast may be *C. tropicalis*. In certain embodiments, the fungus can be a *Yarrowia* fungus. In some embodiments the *Yarrowia* fungus may be *Y. lipolytica*. In certain embodiments, the fungus can be an *Aspergillus* fungus. In some embodiments, the *Aspergillus* fungus may be *A. parasiticus* or *A. nidulans*. In some embodiments, an engineered microorganism as described above may comprise a genetic modification that reduces omega hydroxyl fatty acid conversion. In certain embodiments, the genetic modification can reduce omega hydroxyl fatty acid dehydrogenase activity. In some embodiments the genetic may reduce beta-oxidation activity. In certain embodiments, the genetic modification may reduce a target activity described herein.

Engineered microorganisms can be prepared by altering, introducing or removing nucleotide sequences in the host genome or in stably maintained epigenetic nucleic acid reagents, as noted above. The nucleic acid reagents use to alter, introduce or remove nucleotide sequences in the host genome or epigenetic nucleic acids can be prepared using the methods described herein or available to the artisan.

Nucleic acid sequences having a desired activity can be isolated from cells of a suitable organism using lysis and nucleic acid purification procedures described in a known reference manual (e.g., Maniatis, T., E. F. Fritsch and J. Sambrook (1982) *Molecular Cloning: a Laboratory Manual*; Cold Spring Harbor Laboratory, Cold Spring Harbor, N.Y.) or using commercially available cell lysis and DNA purification reagents and kits. In some embodiments, nucleic acids used to engineer microorganisms can be provided for conducting methods described herein after processing of the organism containing the nucleic acid. For example, the nucleic acid of interest may be extracted, isolated, purified or amplified from a sample (e.g., from an organism of interest or culture containing a plurality of organisms of interest, like yeast or bacteria for example). The term "isolated" as used herein refers to nucleic acid removed from its original environment (e.g., the natural environment if it is naturally occurring, or a host cell if expressed exogenously), and thus is altered "by the hand of man" from its original environment. An isolated nucleic acid generally is provided with fewer non-nucleic acid components (e.g., protein, lipid) than the amount of components present in a source sample. A composition comprising isolated sample nucleic acid can be substantially isolated (e.g., about 90%, 91%, 92%, 93%, 94%, 95%, 96%, 97%, 98%, 99% or greater than 99% free of non-nucleic acid components). The term "purified" as used herein refers to sample nucleic acid provided that contains fewer nucleic acid species than in the sample source from which the sample nucleic acid is derived. A composition comprising sample nucleic acid may be substantially purified (e.g., about 90%, 91%, 92%, 93%, 94%, 95%, 96%, 97%, 98%, 99% or greater than 99% free of other nucleic acid species). The term "amplified" as used herein refers to subjecting nucleic acid of a cell, organism or sample to a process that linearly or exponentially generates amplicon nucleic acids having the same or substantially the same nucleotide sequence as the nucleotide sequence of the nucleic acid in the sample, or portion thereof. As noted above, the nucleic acids used to prepare nucleic acid reagents as described herein can be subjected to fragmentation or cleavage.

Amplification of nucleic acids is sometimes necessary when dealing with organisms that are difficult to culture. Where amplification may be desired, any suitable amplification technique can be utilized. Non-limiting examples of methods for amplification of polynucleotides include, polymerase chain reaction (PCR); ligation amplification (or ligase chain reaction (LCR)); amplification methods based on the use of Q-beta replicase or template-dependent polymerase (see US Patent Publication Number US20050287592); helicase-dependent isothermal amplification (Vincent et al., "Helicase-dependent isothermal DNA amplification". EMBO reports 5 (8): 795-800 (2004));

strand displacement amplification (SDA); thermophilic SDA nucleic acid sequence based amplification (3SR or NASBA) and transcription-associated amplification (TAA). Non-limiting examples of PCR amplification methods include standard PCR, AFLP-PCR, Allele-specific PCR, Alu-PCR, Asymmetric PCR, Colony PCR, Hot start PCR, Inverse PCR (IPCR), In situ PCR (ISH), Intersequence-specific PCR (ISSR-PCR), Long PCR, Multiplex PCR, Nested PCR, Quantitative PCR, Reverse Transcriptase PCR (RT-PCR), Real Time PCR, Single cell PCR, Solid phase PCR, combinations thereof, and the like. Reagents and hardware for conducting PCR are commercially available.

Protocols for conducting the various type of PCR listed above are readily available to the artisan. PCR conditions can be dependent upon primer sequences, target abundance, and the desired amount of amplification, and therefore, one of skill in the art may choose from a number of PCR protocols available (see, e.g., U.S. Pat. Nos. 4,683,195 and 4,683,202; and PCR Protocols: A Guide to Methods and Applications, Innis et al., eds, 1990. PCR often is carried out as an automated process with a thermostable enzyme. In this process, the temperature of the reaction mixture is cycled through a denaturing region, a primer-annealing region, and an extension reaction region automatically. Machines specifically adapted for this purpose are commercially available. A non-limiting example of a PCR protocol that may be suitable for embodiments described herein is, treating the sample at 95° C. for 5 minutes; repeating forty-five cycles of 95° C. for 1 minute, 59° C. for 1 minute, 10 seconds, and 72° C. for 1 minute 30 seconds; and then treating the sample at 72° C. for 5 minutes. Additional PCR protocols are described in the example section. Multiple cycles frequently are performed using a commercially available thermal cycler. Suitable isothermal amplification processes known and selected by the person of ordinary skill in the art also may be applied, in certain embodiments. In some embodiments, nucleic acids encoding polypeptides with a desired activity can be isolated by amplifying the desired sequence from an organism having the desired activity using oligonucleotides or primers designed based on sequences described herein.

Amplified, isolated and/or purified nucleic acids can be cloned into the recombinant DNA vectors described in Figures herein or into suitable commercially available recombinant DNA vectors. Cloning of nucleic acid sequences of interest into recombinant DNA vectors can facilitate further manipulations of the nucleic acids for preparation of nucleic acid reagents, (e.g., alteration of nucleotide sequences by mutagenesis, homologous recombination, amplification and the like, for example). Standard cloning procedures (e.g., enzymic digestion, ligation, and the like) are known (e.g., described in Maniatis, T., E. F. Fritsch and J. Sambrook (1982) *Molecular Cloning: a Laboratory Manual*; Cold Spring Harbor Laboratory, Cold Spring Harbor, N.Y.).

In some embodiments, nucleic acid sequences prepared by isolation or amplification can be used, without any further modification, to add an activity to a microorganism and thereby create a genetically modified or engineered microorganism. In certain embodiments, nucleic acid sequences prepared by isolation or amplification can be genetically modified to alter (e.g., increase or decrease, for example) a desired activity. In some embodiments, nucleic acids, used to add an activity to an organism, sometimes are genetically modified to optimize the heterologous polynucleotide sequence encoding the desired activity (e.g., polypeptide or protein, for example). The term "optimize" as used herein can refer to alteration to increase or enhance expression by preferred codon usage. The term optimize can also refer to modifications to the amino acid sequence to increase the activity of a polypeptide or protein, such that the activity exhibits a higher catalytic activity as compared to the "natural" version of the polypeptide or protein.

Nucleic acid sequences of interest can be genetically modified using methods known in the art. Mutagenesis techniques are particularly useful for small scale (e.g., 1, 2, 5, 10 or more nucleotides) or large scale (e.g., 50, 100, 150, 200, 500, or more nucleotides) genetic modification. Mutagenesis allows the artisan to alter the genetic information of an organism in a stable manner, either naturally (e.g., isolation using selection and screening) or experimentally by the use of chemicals, radiation or inaccurate DNA replication (e.g., PCR mutagenesis). In some embodiments, genetic modification can be performed by whole scale synthetic synthesis of nucleic acids, using a native nucleotide sequence as the reference sequence, and modifying nucleotides that can result in the desired alteration of activity. Mutagenesis methods sometimes are specific or targeted to specific regions or nucleotides (e.g., site-directed mutagenesis, PCR-based site-directed mutagenesis, and in vitro mutagenesis techniques such as transplacement and in vivo oligonucleotide site-directed mutagenesis, for example). Mutagenesis methods sometimes are non-specific or random with respect to the placement of genetic modifications (e.g., chemical mutagenesis, insertion element (e.g., insertion or transposon elements) and inaccurate PCR based methods, for example).

Site directed mutagenesis is a procedure in which a specific nucleotide or specific nucleotides in a DNA molecule are mutated or altered. Site directed mutagenesis typically is performed using a nucleic acid sequence of interest cloned into a circular plasmid vector. Site-directed mutagenesis requires that the wild type sequence be known and used a platform for the genetic alteration. Site-directed mutagenesis sometimes is referred to as oligonucleotide-directed mutagenesis because the technique can be performed using oligonucleotides which have the desired genetic modification incorporated into the complement a nucleotide sequence of interest. The wild type sequence and the altered nucleotide are allowed to hybridize and the hybridized nucleic acids are extended and replicated using a DNA polymerase. The double stranded nucleic acids are introduced into a host (e.g., *E. coli*, for example) and further rounds of replication are carried out in vivo. The transformed cells carrying the mutated nucleic acid sequence are then selected and/or screened for those cells carrying the correctly mutagenized sequence. Cassette mutagenesis and PCR-based site-directed mutagenesis are further modifications of the site-directed mutagenesis technique. Site-directed mutagenesis can also be performed in vivo (e.g., transplacement "pop-in pop-out", In vivo site-directed mutagenesis with synthetic oligonucleotides and the like, for example).

PCR-based mutagenesis can be performed using PCR with oligonucleotide primers that contain the desired mutation or mutations. The technique functions in a manner similar to standard site-directed mutagenesis, with the exception that a thermocycler and PCR conditions are used to replace replication and selection of the clones in a microorganism host. As PCR-based mutagenesis also uses a circular plasmid vector, the amplified fragment (e.g., linear nucleic acid molecule) containing the incorporated genetic modifications can be separated from the plasmid containing the template sequence after a sufficient number of rounds of thermocycler amplification, using standard electrophoretic procedures. A modification of this method uses linear amplification methods and a pair of mutagenic primers that amplify the entire plasmid. The procedure takes advantage of the E. coli Dam methylase system which causes DNA replicated in vivo to be sensitive to the restriction endonucleases DpnI. PCR synthesized DNA is not methylated and is therefore resistant to DpnI. This approach allows the template plasmid to be digested, leaving the genetically modified, PCR synthesized plasmids to be isolated and transformed into a host bacteria for DNA repair and replication, thereby facilitating subsequent cloning and identification steps. A certain amount of randomness can be added to PCR-based sited directed mutagenesis by using partially degenerate primers.

Recombination sometimes can be used as a tool for mutagenesis. Homologous recombination allows the artisan to specifically target regions of known sequence for insertion of heterologous nucleotide sequences using the host organisms natural DNA replication and repair enzymes. Homologous recombination methods sometimes are referred to as "pop in pop out" mutagenesis, transplacement, knock out mutagenesis or knock in mutagenesis. Integration of a nucleic acid sequence into a host genome is a single cross over event, which inserts the entire nucleic acid reagent (e.g., pop in). A second cross over event excises all but a portion of the nucleic acid reagent, leaving behind a heterologous sequence, often referred to as a "footprint" (e.g., pop out). Mutagenesis by insertion (e.g., knock in) or by double recombination leaving behind a disrupting heterologous nucleic acid (e.g., knock out) both server to disrupt or "knock out" the function of the gene or nucleic acid sequence in which insertion occurs. By combining selectable markers and/or auxotrophic markers with nucleic acid reagents designed to provide the appropriate nucleic acid target sequences, the artisan can target a selectable nucleic acid reagent to a specific region, and then select for recombination events that "pop out" a portion of the inserted (e.g., "pop in") nucleic acid reagent.

Such methods take advantage of nucleic acid reagents that have been specifically designed with known target nucleic acid sequences at or near a nucleic acid or genomic region of interest. Popping out typically leaves a "foot print" of left over sequences that remain after the recombination event. The left over sequence can disrupt a gene and thereby reduce or eliminate expression of that gene. In some embodiments, the method can be used to insert sequences, upstream or downstream of genes that can result in an enhancement or reduction in expression of the gene. In certain embodiments, new genes can be introduced into the genome of a host organism using similar recombination or "pop in" methods. An example of a yeast recombination system using the ura3 gene and 5-FOA were described briefly above and further detail is presented herein.

A method for modification is described in Alani et al., "A method for gene disruption that allows repeated use of URA3 selection in the construction of multiply disrupted yeast strains", Genetics 116(4):541-545 August 1987. The original method uses a Ura3 cassette with 1000 base pairs (bp) of the same nucleotide sequence cloned in the same orientation on either side of the URA3 cassette. Targeting sequences of about 50 bp are added to each side of the construct. The double stranded targeting sequences are complementary to sequences in the genome of the host organism. The targeting sequences allow site-specific recombination in a region of interest. The modification of the original technique replaces the two 1000 bp sequence direct repeats with two 200 bp direct repeats. The modified method also uses 50 bp targeting sequences. The modification reduces or eliminates recombination of a second knock out into the 1000 bp repeat left behind in a first mutagenesis, therefore allowing multiply knocked out yeast. Additionally, the 200 bp sequences used herein are uniquely designed, self-assembling sequences that leave behind identifiable footprints. The technique used to design the sequences incorporate design features such as low identity to the yeast genome, and low identity to each other. Therefore a library of the self-assembling sequences can be generated to allow multiple knockouts in the same organism, while reducing or eliminating the potential for integration into a previous knockout.

As noted above, the URA3 cassette makes use of the toxicity of 5-FOA in yeast carrying a functional URA3 gene. Uracil synthesis deficient yeast are transformed with the modified URA3 cassette, using standard yeast transformation protocols, and the transformed cells are plated on minimal media minus uracil. In some embodiments, PCR can be used to verify correct insertion into the region of interest in the host genome, and certain embodiments the PCR step can be omitted. Inclusion of the PCR step can reduce the number of transformants that need to be counter selected to "pop out" the URA3 cassette. The transformants (e.g., all or the ones determined to be correct by PCR, for example) can then be counter-selected on media containing 5-FOA, which will select for recombination out (e.g., popping out) of the URA3 cassette, thus rendering the yeast ura3 deficient again, and resistant to 5-FOA toxicity. Targeting sequences used to direct recombination events to specific regions are presented herein. A modification of the method described above can be used to integrate genes in to the chromosome, where after recombination a functional gene is left in the chromosome next to the 200 bp footprint.

In some embodiments, other auxotrophic or dominant selection markers can be used in place of URA3 (e.g., an auxotrophic selectable marker), with the appropriate change in selection media and selection agents. Auxotrophic selectable markers are used in strains deficient for synthesis of a required biological molecule (e.g., amino acid or nucleoside, for example). Non-limiting examples of additional auxotrophic markers include; HIS3, TRP1, LEU2, LEU2-d, and LYS2. Certain auxotrophic markers (e.g., URA3 and LYS2) allow counter selection to select for the second recombination event that pops out all but one of the direct repeats of the recombination construct. HIS3 encodes an activity involved in histidine synthesis. TRP1 encodes an activity involved in tryptophan synthesis. LEU2 encodes an activity involved in leucine synthesis. LEU2-d is a low expression version of LEU2 that selects for increased copy number (e.g., gene or plasmid copy number, for example) to allow survival on minimal media without leucine. LYS2 encodes an activity involved in lysine synthesis, and allows counter selection for recombination out of the LYS2 gene using alpha-amino adipate (α-amino adipate).

Dominant selectable markers are useful because they also allow industrial and/or prototrophic strains to be used for genetic manipulations. Additionally, dominant selectable markers provide the advantage that rich medium can be used for plating and culture growth, and thus growth rates are markedly increased. Non-limiting examples of dominant selectable markers include; Tn903 $kan^r$, $Cm^r$, $Hyg^r$, CUP1, and DHFR. Tn903 $kan^r$ encodes an activity involved in kanamycin antibiotic resistance (e.g., typically neomycin phosphotransferase II or NPTII, for example). $Cm^r$ encodes an activity involved in chloramphenicol antibiotic resistance (e.g., typically chloramphenicol acetyl transferase or CAT, for example). Hyg$^r$ encodes an activity involved in hygromycin resistance by phosphorylation of hygromycin B (e.g., hygromycin phosphotransferase, or HPT). CUP1 encodes an activity involved in resistance to heavy metal (e.g., copper, for example) toxicity. DHFR encodes a dihydrofolate reductase activity which confers resistance to methotrexate and sulfanilamde compounds.

In contrast to site-directed or specific mutagenesis, random mutagenesis does not require any sequence information and can be accomplished by a number of widely different methods. Random mutagenesis often is used to create mutant libraries that can be used to screen for the desired genotype or phenotype. Non-limiting examples of random mutagenesis include; chemical mutagenesis, UV-induced mutagenesis, insertion element or transposon-mediated mutagenesis, DNA shuffling, error-prone PCR mutagenesis, and the like.

Chemical mutagenesis often involves chemicals like ethyl methanesulfonate (EMS), nitrous acid, mitomycin C, N-methyl-N-nitrosourea (MNU), diepoxybutane (DEB), 1, 2, 7, 8-diepoxyoctane (DEO), methyl methane sulfonate (MMS), N-methyl-N'-nitro-N-nitrosoguanidine (MNNG), 4-nitroquinoline 1-oxide (4-NQO), 2-methyloxy-6-chloro-9 (3-[ethyl-2-chloroethyl]-aminopropylamino)-acridinedihydrochloride (ICR-170), 2-amino purine (2AP), and hydroxylamine (HA), provided herein as non-limiting examples. These chemicals can cause base-pair substitutions, frameshift mutations, deletions, transversion mutations, transition mutations, incorrect replication, and the like. In some embodiments, the mutagenesis can be carried out in vivo. Sometimes the mutagenic process involves the use of the host organisms DNA replication and repair mechanisms to incorporate and replicate the mutagenized base or bases.

Another type of chemical mutagenesis involves the use of base-analogs. The use of base-analogs cause incorrect base pairing which in the following round of replication is corrected to a mismatched nucleotide when compared to the starting sequence. Base analog mutagenesis introduces a small amount of non-randomness to random mutagenesis, because specific base analogs can be chose which can be incorporated at certain nucleotides in the starting sequence. Correction of the mispairing typically yields a known substitution. For example, Bromo-deoxyuridine (BrdU) can be incorporated into DNA and replaces T in the sequence. The host DNA repair and replication machinery can sometime correct the defect, but sometimes will mispair the BrdU with a G. The next round of replication then causes a G-C transversion from the original A-T in the native sequence.

Ultra violet (UV) induced mutagenesis is caused by the formation of thymidine dimers when UV light irradiates chemical bonds between two adjacent thymine residues. Excision repair mechanism of the host organism correct the lesion in the DNA, but occasionally the lesion is incorrectly repaired typically resulting in a C to T transition.

Insertion element or transposon-mediated mutagenesis makes use of naturally occurring or modified naturally occurring mobile genetic elements. Transposons often encode accessory activities in addition to the activities necessary for transposition (e.g., movement using a transposase activity, for example). In many examples, transposon accessory activities are antibiotic resistance markers (e.g., see Tn903 kan$^r$ described above, for example). Insertion elements typically only encode the activities necessary for movement of the nucleic acid sequence. Insertion element and transposon mediated mutagenesis often can occur randomly, however specific target sequences are known for some transposons. Mobile genetic elements like IS elements or Transposons (Tn) often have inverted repeats, direct repeats or both inverted and direct repeats flanking the region coding for the transposition genes. Recombination events catalyzed by the transposase cause the element to remove itself from the genome and move to a new location, leaving behind a portion of an inverted or direct repeat. Classic examples of transposons are the "mobile genetic elements" discovered in maize. Transposon mutagenesis kits are commercially available which are designed to leave behind a 5 codon insert (e.g., Mutation Generation System kit, Finnzymes). This allows the artisan to identify the insertion site, without fully disrupting the function of most genes.

DNA shuffling is a method which uses DNA fragments from members of a mutant library and reshuffles the fragments randomly to generate new mutant sequence combinations. The fragments are typically generated using DNaseI, followed by random annealing and re-joining using self priming PCR. The DNA overhanging ends, from annealing of random fragments, provide "primer" sequences for the PCR process. Shuffling can be applied to libraries generated by any of the above mutagenesis methods.

Error prone PCR and its derivative rolling circle error prone PCR uses increased magnesium and manganese concentrations in conjunction with limiting amounts of one or two nucleotides to reduce the fidelity of the Taq polymerase. The error rate can be as high as 2% under appropriate conditions, when the resultant mutant sequence is compared to the wild type starting sequence. After amplification, the library of mutant coding sequences must be cloned into a suitable plasmid. Although point mutations are the most common types of mutation in error prone PCR, deletions and frameshift mutations are also possible. There are a number of commercial error-prone PCR kits available, including those from Stratagene and Clontech. Rolling circle error-prone PCR is a variant of error-prone PCR in which wild-type sequence is first cloned into a plasmid, then the whole plasmid is amplified under error-prone conditions.

As noted above, organisms with altered activities can also be isolated using genetic selection and screening of organisms challenged on selective media or by identifying naturally occurring variants from unique environments. For example, 2-Deoxy-D-glucose is a toxic glucose analog. Growth of yeast on this substance yields mutants that are glucose-deregulated. A number of mutants have been isolated using 2-Deoxy-D-glucose including transport mutants, and mutants that ferment glucose and galactose simultaneously instead of glucose first then galactose when glucose is depleted. Similar techniques have been used to isolate mutant microorganisms that can metabolize plastics (e.g., from landfills), petrochemicals (e.g., from oil spills), and the like, either in a laboratory setting or from unique environments.

Similar methods can be used to isolate naturally occurring mutations in a desired activity when the activity exists at a relatively low or nearly undetectable level in the organism of choice, in some embodiments. The method generally consists of growing the organism to a specific density in liquid culture, concentrating the cells, and plating the cells on various concentrations of the substance to which an increase in metabolic activity is desired. The cells are incubated at a moderate growth temperature, for 5 to 10 days. To enhance the selection process, the plates can be stored for another 5 to 10 days at a low temperature. The low temperature sometimes can allow strains that have gained or increased an activity to continue growing while other strains are inhibited for growth at the low temperature. Following the initial selection and secondary growth at low temperature, the plates can be replica plated on higher or lower concentrations of the selection substance to further select for the desired activity.

A native, heterologous or mutagenized polynucleotide can be introduced into a nucleic acid reagent for introduction into a host organism, thereby generating an engineered microorganism. Standard recombinant DNA techniques (restriction enzyme digests, ligation, and the like) can be used by the artisan to combine the mutagenized nucleic acid of interest into a suitable nucleic acid reagent capable of (i) being stably maintained by selection in the host organism, or (ii) being integrating into the genome of the host organism. As noted above, sometimes nucleic acid reagents comprise two replication origins to allow the same nucleic acid reagent to be manipulated in bacterial before final introduction of the final product into the host organism (e.g., yeast or fungus for example). Standard molecular biology and recombinant DNA methods are known (e.g., described in Maniatis, T., E. F. Fritsch and J. Sambrook (1982) *Molecular Cloning: a Laboratory Manual*; Cold Spring Harbor Laboratory, Cold Spring Harbor, N.Y.).

Nucleic acid reagents can be introduced into microorganisms using various techniques. Non-limiting examples of methods used to introduce heterologous nucleic acids into various organisms include; transformation, transfection, transduction, electroporation, ultrasound-mediated transformation, particle bombardment and the like. In some instances the addition of carrier molecules (e.g., bis-benzimdazolyl compounds, for example, see U.S. Pat. No. 5,595,899) can increase the uptake of DNA in cells typically thought to be difficult to transform by conventional methods. Conventional methods of transformation are known (e.g., described in Maniatis, T., E. F. Fritsch and J. Sambrook (1982) *Molecular Cloning: a Laboratory Manual*; Cold Spring Harbor Laboratory, Cold Spring Harbor, N.Y.).

Feedstocks, Media, Supplements & Additives

Engineered microorganisms often are cultured under conditions that optimize yield of a fatty dicarboxylic acid (e.g., an eight to eighteen-carbon fatty dicarboxylic acid). Non-limiting examples of fatty dicarboxylic acids include suberic acid (i.e., octanedioic acid, 1,8-octanedioic acid, octanedioic acid, octane-1,8-dioic acid, 1,6-hexanedicarboxylic acid, capryllic diacids), sebacic acid (i.e., 1,10-decanedioic acid, decanedioic acid, decane-1,10-dioic acid, 1,8-octanedicarboxylic acid, capric diacid), dodecanedioic acid (i.e., DDDA, 1,12-dodecanedioic acid, dodecanedioic acid, dodecane-1,12-dioic acid, 1,10-decanedicarboxylic acid, decamethylenedicaboxylic acid, 1,10-dicarboxydecane, lauric diacid), tetradecanedioic acid (i.e., TDDA, 1,14-tetradecanedioic acid, tetradecanedioic acid, tetradecane-1,14-dioic acid, 1,12-dodecanedicarboxylic acid, myristic diacid), thapsic acid (i.e., hexadecanedioic acid, 1,16-hexadecanedioic acid, hexadecanedioic acid, hexadecane-1,16-dioic acid, 1,14-tetradecanedicarboxylic acid, palmitic diacid), cis-9-hexadecenedioic acid (i.e., palmitoleic diacids), octanedioic acid (i.e., 1,18-octadecanedioic acid, octadecanedioic acid, octadecane-1,18-dioic acid, 1,16-hexadecanedicarboxylic acid, stearic diacid), cis-9-octadecenedioic acid (i.e., oleic diacids), cis-9,12-octadecenedioic acid (i.e., linoleic diacids), cis-9,12,15-octadecenedioic acid (i.e., linolenic diacids), arachidic diacid (i.e., eicosanoic diacid, icosanoic diacid, 11-eicosenoic diacid (i.e., cis-11-eicosenedioic acid), 13-eicosenoic diacids (i.e., cis-13-eicosenedioic acid), arachidonic diacid (i.e., cis-5,8,11,14-eicosatetraenedioic acid). Culture conditions often optimize activity of one or more of the following activities: omega oxo fatty acid dehydrogenase activity, omega hydroxyl fatty acid dehydrogenase activity, acetyl CoA carboxylase activity, monooxygenase activity, monooxygenase reductase activity, fatty alcohol oxidase, acyl-CoA ligase, acyl-CoA oxidase, enoyl-CoA hydratase, 3-hydroxyacyl-CoA dehydrogenase, and/or acyltransferase (e.g., acetyl-CoA C-acyltransferase) activities. In general, non-limiting examples of conditions that may be optimized include the type and amount of carbon source, the type and amount of nitrogen source, the carbon-to-nitrogen ratio, the oxygen level, growth temperature, pH, length of the biomass production phase, length of target product accumulation phase, and time of cell harvest.

Culture media generally contain a suitable carbon source. Carbon sources useful for culturing microorganisms and/or fermentation processes sometimes are referred to as feedstocks. The term "feedstock" as used herein refers to a composition containing a carbon source that is provided to an organism, which is used by the organism to produce energy and metabolic products useful for growth. A feedstock may be a natural substance, a "man-made substance," a purified or isolated substance, a mixture of purified substances, a mixture of unpurified substances or combinations thereof. A feedstock often is prepared by and/or provided to an organism by a person, and a feedstock often is formulated prior to administration to the organism. A carbon source may comprise, but is not limited to including, one or more of the following substances: alkanes, alkenes, mono-carboxylic acids, di-carboxylic acids, monosaccharides (e.g., also referred to as "saccharides," which include 6-carbon sugars (e.g., glucose, fructose), 5-carbon sugars (e.g., xylose and other pentoses) and the like), disaccharides (e.g., lactose, sucrose), oligosaccharides (e.g., glycans, homopolymers of a monosaccharide), polysaccharides (e.g., starch, cellulose, heteropolymers of monosaccharides or mixtures thereof), sugar alcohols (e.g., glycerol), and renewable feedstocks (e.g., cheese whey permeate, cornsteep liquor, sugar beet molasses, barley malt).

Carbon sources also can be selected from one or more of the following non-limiting examples: paraffin (e.g., saturated paraffin, unsaturated paraffin, substituted paraffin, linear paraffin, branched paraffin, or combinations thereof); alkanes (e.g., dodecane), alkenes or alkynes, each of which may be linear, branched, saturated, unsaturated, substituted or combinations thereof (described in greater detail below); linear or branched alcohols (e.g., dodecanol); fatty acids (e.g., about 1 carbon to about 60 carbons, including free fatty acids such as, without limitation, caproic acid, capryllic acid, capric acid, lauric acid, myristic acid, palmitic acid, palmitoleic acid, stearic acid, oleic acid, linoleic acid, linolenic acid), or soap stock, for example; esters (such as methyl esters, ethyl esters, butyl estes, and the like) of fatty acids including, without limitation, esters such as methyl caprate, ethyl caprate, methyl laurate, ethyl laurate, methyl myristate, ethyl myristate, methyl caprolate, ethyl caprolate, ethyl caprillic, methyl caprillic, methyl palmitate, or ethyl palmitate; monoglycerides; diglycerides; triglycerides, phospholipids. Non-limiting commercial sources of products for preparing feedstocks include plants, plant oils or plant products (e.g., vegetable oils (e.g., almond oil, canola oil, cocoa butter, coconut oil, corn oil, cottonseed oil, flaxseed oil, grape seed oil, illipe, olive oil, palm oil, palm olein, palm kernel oil, safflower oil, peanut oil, soybean oil, sesame oil, shea nut oil, sunflower oil walnut oil, the like and combinations thereof) and animal fats (e.g., beef tallow, butterfat, lard, cod liver oil). A carbon source may include a petroleum product and/or a petroleum distillate (e.g., diesel, fuel oils, gasoline, kerosene, paraffin wax, paraffin oil, petrochemicals). In some embodiments, a feedstock comprises petroleum distillate. A carbon source can be a fatty acid distillate (e.g., a palm oil distillate or corn oil distillate). Fatty acid distillates can be by-products from the refining of crude plant oils. In some embodiments, a feedstock comprises a fatty acid distillate.

In some embodiments, a feedstock comprises a soapstock (i.e. soap stock). A widely practiced method for purifying crude vegetable oils for edible use is the alkali or caustic refining method. This process employs a dilute aqueous solution of caustic soda to react with the free fatty acids present which results in the formation of soaps. The soaps together with hydrated phosphatides, gums and prooxidant metals are typically separated from the refined oil as the heavy phase discharge from the refining centrifuge and are typically known as soapstock.

A carbon source also may include a metabolic product that can be used directly as a metabolic substrate in an engineered pathway described herein, or indirectly via conversion to a different molecule using engineered or native biosynthetic pathways in an engineered microorganism. In certain embodiments, metabolic pathways can be preferentially biased towards production of a desired product by increasing the levels of one or more activities in one or more metabolic pathways having and/or generating at least one common metabolic and/or synthetic substrate. In some embodiments, a metabolic byproduct (e.g., fatty acid) of an engineered activity (e.g., omega oxidation activity) can be used in one or more metabolic pathways selected from gluconeogenesis, pentose phosphate pathway, glycolysis, fatty acid synthesis, beta oxidation, and omega oxidation, to generate a carbon source that can be converted to a fatty dicarboxylic acid (e.g., octanedioic acid, decanedioic acid, dodecanedioic acid, tetradecanedioic acid, hexadecanedioic acid, octadecanedioic acid, eicosanedioic acid).

The term "paraffin" as used herein refers to the common name for alkane hydrocarbons, independent of the source (e.g., plant derived, petroleum derived, chemically synthesized, fermented by a microorganism), or carbon chain length. A carbon source sometimes comprises a paraffin, and in some embodiments, a paraffin is predominant in a carbon source (e.g., about 75%, 80%, 85%, 90% or 95% paraffin). A paraffin sometimes is saturated (e.g., fully saturated), sometimes includes one or more unsaturations (e.g., about 1, 2, 3, 4, 5, 6, 7, 8, 9, 10 unsaturations) and sometimes is substituted with one or more non-hydrogen substituents. Non-limiting examples of non-hydrogen substituents include halo, acetyl, =O, =N—CN, =N—OR, =NR, OR, NR$_2$, SR, SO$_2$R, SO$_2$NR$_2$, NRSO$_2$R, NRCONR$_2$, NRCOOR, NRCOR, CN, COOR, CONR$_2$, OOCR, COR, and NO$_2$, where each R is independently H, C1-C8 alkyl, C2-C8 heteroalkyl, C1-C8 acyl, C2-C8 heteroacyl, C2-C8 alkenyl, C2-C8 heteroalkenyl, C2-C8 alkynyl, C2-C8 heteroalkynyl, C6-C10 aryl, or C5-C10 heteroaryl, and each R' is optionally substituted with halo, =O, =N—CN, =N—OR', =NR', OR', NR'$_2$, SR', SO$_2$R', SO$_2$NR'$_2$, NR'SO$_2$R', NR'CONR'$_2$, NR'COOR', NR'COR', CN, COOR', CONR'$_2$, OOCR', COR', and NO$_2$, where each R' is independently H, C1-C8 alkyl, C2-C8 heteroalkyl, C1-C8 acyl, C2-C8 heteroacyl, C6-C10 aryl or C5-C10 heteroaryl.

In some embodiments a feedstock is selected according to the genotype and/or phenotype of the engineered microorganism to be cultured. For example, a feedstock rich in 12-carbon fatty acids, 12-carbon dicarboxylic acids or 12-carbon paraffins, or a mixture of 10, 12 and 14-carbon compounds can be useful for culturing yeast strains harboring an alteration that partially blocks beta oxidation by disrupting POX4 activity, as described herein. Non-limiting examples of carbon sources having 10 to 14 carbons include fats (e.g., coconut oil, palm kernel oil), paraffins (e.g., alkanes, alkenes, or alkynes) having 10 to 14 carbons, (e.g., dodecane (also referred to as adakane12, bihexyl, dihexyl and duodecane); tetradecane), alkene and alkyne derivatives), fatty acids (dodecanoic acid, tetradecanoic acid), fatty alcohols (dodecanol, tetradecanol), the like, non-toxic substituted derivatives or combinations thereof.

A carbon source sometimes comprises an alkyl, alkenyl or alkynyl compound or molecule (e.g., a compound that includes an alkyl, alkenyl or alkynyl moiety (e.g., alkane, alkene, alkyne)). In certain embodiments, an alkyl, alkenyl or alkynyl molecule, or combination thereof, is predominant in a carbon source (e.g., about 75%, 80%, 85%, 90% or 95% of such molecules). As used herein, the terms "alkyl," "alkenyl" and "alkynyl" include straight-chain (referred to herein as "linear"), branched-chain (referred to herein as "non-linear"), cyclic monovalent hydrocarbyl radicals, and combinations of these, which contain only C and H atoms when they are unsubstituted. Non-limiting examples of alkyl moieties include methyl, ethyl, isobutyl, cyclohexyl, cyclopentylethyl, 2-propenyl, 3-butynyl, and the like. An alkyl that contains only C and H atoms and is unsubstituted sometimes is referred to as "saturated." An alkenyl or alkynyl generally is "unsaturated" as it contains one or more double bonds or triple bonds, respectively. An alkenyl can include any number of double bonds, such as 1, 2, 3, 4 or 5 double bonds, for example. An alkynyl can include any number of triple bonds, such as 1, 2, 3, 4 or 5 triple bonds, for example Alkyl, alkenyl and alkynyl molecules sometimes contain between about 2 to about 60 carbon atoms (C). For example, an alkyl, alkenyl and alkynyl molecule can include about 1 carbon atom, about 2 carbon atoms, about 3 carbon atoms, about 4 carbon atoms, about 5 carbon atoms, about 6 carbon atoms, about 7 carbon atoms, about 8 carbon atoms, about 9 carbon atoms, about 10 carbon atoms, about 12 carbon atoms, about 14 carbon atoms, about 16 carbon atoms, about 18 carbon atoms, about 20 carbon atoms, about 22 carbon atoms, about 24 carbon atoms, about 26 carbon atoms, about 28 carbon atoms, about 30 carbon atoms, about 32 carbon atoms, about 34 carbon atoms, about 36 carbon atoms, about 38 carbon atoms, about 40 carbon atoms, about 42 carbon atoms, about 44 carbon atoms, about 46 carbon atoms, about 48 carbon atoms, about 50 carbon atoms, about 52 carbon atoms, about 54 carbon atoms, about 56 carbon atoms, about 58 carbon atoms or about 60 carbon atoms. In some embodiments, paraffins can have a mean number of carbon atoms of between about 8 to about 18 carbon atoms (e.g., about 8 carbon atoms, about 9 carbon atoms, about 10 carbon atoms, about 11 carbon atoms, about 12 carbon atoms, about 13 carbon atoms, about 14 carbon atoms, about 15 carbon atoms, about 16 carbon atoms, about 17 carbon atoms and about 18 carbon atoms). A single group can include more than one type of multiple bond, or more than one multiple bond. Such groups are included within the definition of the term "alkenyl" when they contain at least one carbon-carbon double bond, and are included within the term "alkynyl" when they contain at least one carbon-carbon triple bond. Alkyl, alkenyl and alkynyl molecules include molecules that comprise an alkyl, alkenyl and/or alkynyl moiety, and include molecules that consist of an alkyl, alkenyl or alkynyl moiety (i.e., alkane, alkene and alkyne molecules). Non-limiting examples of unsaturated fatty acid feedstocks useful for practicing certain embodiments herein include oleic acid, linoleic acid, linolenic acid, eicosenoic acid, palmitoleic acid and arachidonic acid.

Alkyl, alkenyl and alkynyl substituents sometimes contain 1-20C (alkyl) or 2-20C (alkenyl or alkynyl). They can contain about 8-20C or about 10-20C in some embodiments. A single group can include more than one type of multiple bond, or more than one multiple bond. Such groups are included within the definition of the term "alkenyl" when they contain at least one carbon-carbon double bond, and are included within the term "alkynyl" when they contain at least one carbon-carbon triple bond.

Alkyl, alkenyl and alkynyl groups or compounds sometimes are substituted to the extent that such substitution can be synthesized and can exist. Typical substituents include, but are not limited to, halo, acetyl, =O, =N—CN, =N—OR, =NR, OR, $NR_2$, SR, $SO_2R$, $SO_2NR_2$, $NRSO_2R$, $NRCONR_2$, NRCOOR, NRCOR, CN, COOR, $CONR_2$, OOCR, COR, and $NO_2$, where each R is independently H, C1-C8 alkyl, C2-C8 heteroalkyl, C1-C8 acyl, C2-C8 heteroacyl, C2-C8 alkenyl, C2-C8 heteroalkenyl, C2-C8 alkynyl, C2-C8 heteroalkynyl, C6-C11 aryl, or C5-C11 heteroaryl, and each R is optionally substituted with halo, =O, =N—CN, =N—OR', =NR', OR', $NR'_2$, SR', $SO_2R'$, $SO_2NR'_2$, $NR'SO_2R'$, $NR'CONR'_2$, NR'COOR', NR'COR', CN, COOR', $CONR'_2$, OOCR', COR', and $NO_2$, where each R' is independently H, C1-C8 alkyl, C2-C8 heteroalkyl, C1-C8 acyl, C2-C8 heteroacyl, C6-C10 aryl or C5-C10 heteroaryl. Alkyl, alkenyl and alkynyl groups can also be substituted by C1-C8 acyl, C2-C8 heteroacyl, C6-C10 aryl or C5-C10 heteroaryl, each of which can be substituted by the substituents that are appropriate for the particular group.

"Acetylene" or "acetyl" substituents are 2-10C alkynyl groups that are optionally substituted, and are of the formula —C≡C-Ri, where Ri is H or C1-C8 alkyl, C2-C8 heteroalkyl, C2-C8 alkenyl, C2-C8 heteroalkenyl, C2-C8 alkynyl, C2-C8 heteroalkynyl, C1-C8 acyl, C2-C8 heteroacyl, C6-C10 aryl, C5-C10 heteroaryl, C7-C12 arylalkyl, or C6-C12 heteroarylalkyl, and each Ri group is optionally substituted with one or more substituents selected from halo, =O, =N—CN, =N—OR', =NR', OR', NR'2, SR', $SO_2R'$, $SO_2NR'_2$, $NR'SO_2R'$, $NR'CONR'_2$, NR'COOR', NR'COR', CN, COOR', $CONR'_2$, OOCR', COR', and $NO_2$, where each R' is independently H, C1-C6 alkyl, C2-C6 heteroalkyl, C1-C6 acyl, C2-C6 heteroacyl, C6-C10 aryl, C5-C10 heteroaryl, C7-12 arylalkyl, or C6-12 heteroarylalkyl, each of which is optionally substituted with one or more groups selected from halo, C1-C4 alkyl, C1-C4 heteroalkyl, C1-C6 acyl, C1-C6 heteroacyl, hydroxy, amino, and =O; and where two R' can be linked to form a 3-7 membered ring optionally containing up to three heteroatoms selected from N, O and S. In some embodiments, Ri of —C≡C-Ri is H or Me.

A carbon source sometimes comprises a heteroalkyl, heteroalkenyl and/or heteroalkynyl molecule or compound (e.g., comprises heteroalkyl, heteroalkenyl and/or heteroalkynyl moiety (e.g., heteroalkane, heteroalkene or heteroalkyne)). "Heteroalkyl", "heteroalkenyl", and "heteroalkynyl" and the like are defined similarly to the corresponding hydrocarbyl (alkyl, alkenyl and alkynyl) groups, but the 'hetero' terms refer to groups that contain one to three O, S or N heteroatoms or combinations thereof within the backbone; thus at least one carbon atom of a corresponding alkyl, alkenyl, or alkynyl group is replaced by one of the specified heteroatoms to form a heteroalkyl, heteroalkenyl, or heteroalkynyl group. The typical and sizes for heteroforms of alkyl, alkenyl and alkynyl groups are generally the same as for the corresponding hydrocarbyl groups, and the substituents that may be present on the heteroforms are the same as those described above for the hydrocarbyl groups. For reasons of chemical stability, it is also understood that, unless otherwise specified, such groups do not include more than two contiguous heteroatoms except where an oxo group is present on N or S as in a nitro or sulfonyl group.

The term "alkyl" as used herein includes cycloalkyl and cycloalkylalkyl groups and compounds, the term "cycloalkyl" may be used herein to describe a carbocyclic non-aromatic compound or group that is connected via a ring carbon atom, and "cycloalkylalkyl" may be used to describe a carbocyclic non-aromatic compound or group that is connected to a molecule through an alkyl linker. Similarly, "heterocyclyl" may be used to describe a non-aromatic cyclic group that contains at least one heteroatom as a ring member and that is connected to the molecule via a ring atom, which may be C or N; and "heterocyclylalkyl" may be used to describe such a group that is connected to another molecule through a linker. The sizes and substituents that are suitable for the cycloalkyl, cycloalkylalkyl, heterocyclyl, and heterocyclylalkyl groups are the same as those described above for alkyl groups. As used herein, these terms also include rings that contain a double bond or two, as long as the ring is not aromatic.

A carbon source sometimes comprises an acyl compound or moiety (e.g., compound comprising an acyl moiety). As used herein, "acyl" encompasses groups comprising an alkyl, alkenyl, alkynyl, aryl or arylalkyl radical attached at one of the two available valence positions of a carbonyl carbon atom, and heteroacyl refers to the corresponding groups where at least one carbon other than the carbonyl carbon has been replaced by a heteroatom chosen from N, O and S. Thus heteroacyl includes, for example, —C(=O)OR and —C(=O)$NR_2$ as well as —C(=O)-heteroaryl.

Acyl and heteroacyl groups are bonded to any group or molecule to which they are attached through the open valence of the carbonyl carbon atom. Typically, they are C1-C8 acyl groups, which include formyl, acetyl, pivaloyl, and benzoyl, and C2-C8 heteroacyl groups, which include methoxyacetyl, ethoxycarbonyl, and 4-pyridinoyl. The hydrocarbyl groups, aryl groups, and heteroforms of such groups that comprise an acyl or heteroacyl group can be substituted with the substituents described herein as generally suitable substituents for each of the corresponding component of the acyl or heteroacyl group.

A carbon source sometimes comprises one or more aromatic moieties and/or heteroaromatic moieties. "Aromatic" moiety or "aryl" moiety refers to a monocyclic or fused bicyclic moiety having the well-known characteristics of aromaticity; examples include phenyl and naphthyl. Similarly, "heteroaromatic" and "heteroaryl" refer to such monocyclic or fused bicyclic ring systems which contain as ring members one or more heteroatoms selected from O, S and N. The inclusion of a heteroatom permits aromaticity in 5 membered rings as well as 6 membered rings. Typical heteroaromatic systems include monocyclic C5-C6 aromatic groups such as pyridyl, pyrimidyl, pyrazinyl, thienyl, furanyl, pyrrolyl, pyrazolyl, thiazolyl, oxazolyl, and imidazolyl and the fused bicyclic moieties formed by fusing one of these monocyclic groups with a phenyl ring or with any of the heteroaromatic monocyclic groups to form a C8-C10 bicyclic group such as indolyl, benzimidazolyl, indazolyl, benzotriazolyl, isoquinolyl, quinolyl, benzothiazolyl, benzofuranyl, pyrazolopyridyl, quinazolinyl, quinoxalinyl, cinnolinyl, and the like. Any monocyclic or fused ring bicyclic system which has the characteristics of aromaticity in terms of electron distribution throughout the ring system is included in this definition. It also includes bicyclic groups where at least the ring which is directly attached to the remainder of the molecule has the characteristics of aromaticity. Typically, the ring systems contain 5-12 ring member atoms. The monocyclic heteroaryls sometimes contain 5-6 ring members, and the bicyclic heteroaryls sometimes contain 8-10 ring members.

Aryl and heteroaryl moieties may be substituted with a variety of substituents including C1-C8 alkyl, C2-C8 alkenyl, C2-C8 alkynyl, C5-C12 aryl, C1-C8 acyl, and heteroforms of these, each of which can itself be further substituted; other substituents for aryl and heteroaryl moieties include halo, OR, $NR_2$, SR, $SO_2R$, $SO_2NR_2$, $NRSO_2R$, $NRCONR_2$, NRCOOR, NRCOR, CN, COOR, $CONR_2$, OOCR, COR, and $NO_2$, where each R is independently H, C1-C8 alkyl, C2-C8 heteroalkyl, C2-C8 alkenyl, C2-C8 heteroalkenyl, C2-C8 alkynyl, C2-C8 heteroalkynyl, C6-C10 aryl, C5-C10 heteroaryl, C7-C12 arylalkyl, or C6-C12 heteroarylalkyl, and each R is optionally substituted as described above for alkyl groups. The substituent groups on an aryl or heteroaryl group may be further substituted with the groups described herein as suitable for each type of such substituents or for each component of the substituent. Thus, for example, an arylalkyl substituent may be substituted on the aryl portion with substituents typical for aryl groups, and it may be further substituted on the alkyl portion with substituents as typical or suitable for alkyl groups.

Similarly, "arylalkyl" and "heteroarylalkyl" refer to aromatic and heteroaromatic ring systems, which are standalone molecules (e.g., benzene or substituted benzene, pyridine or substituted pyridine), or which are bonded to an attachment point through a linking group such as an alkylene, including substituted or unsubstituted, saturated or unsaturated, cyclic or acyclic linkers. A linker often is C1-C8 alkyl or a hetero form thereof. These linkers also may include a carbonyl group, thus making them able to provide substituents as an acyl or heteroacyl moiety. An aryl or heteroaryl ring in an arylalkyl or heteroarylalkyl group may be substituted with the same substituents described above for aryl groups. An arylalkyl group sometimes includes a phenyl ring optionally substituted with the groups defined above for aryl groups and a C1-C4 alkylene that is unsubstituted or is substituted with one or two C1-C4 alkyl groups or heteroalkyl groups, where the alkyl or heteroalkyl groups can optionally cyclize to form a ring such as cyclopropane, dioxolane, or oxacyclopentane. Similarly, a heteroarylalkyl group often includes a C5-C6 monocyclic heteroaryl group optionally substituted with one or more of the groups described above as substituents typical on aryl groups and a C1-C4 alkylene that is unsubstituted. A heteroarylalkyl group sometimes is substituted with one or two C1-C4 alkyl groups or heteroalkyl groups, or includes an optionally substituted phenyl ring or C5-C6 monocyclic heteroaryl and a C1-C4 heteroalkylene that is unsubstituted or is substituted with one or two C1-C4 alkyl or heteroalkyl groups, where the alkyl or heteroalkyl groups can optionally cyclize to form a ring such as cyclopropane, dioxolane, or oxacyclopentane.

Where an arylalkyl or heteroarylalkyl group is described as optionally substituted, the substituents may be on the alkyl or heteroalkyl portion or on the aryl or heteroaryl portion of the group. The substituents optionally present on the alkyl or heteroalkyl portion sometimes are the same as those described above for alkyl groups, and the substituents optionally present on the aryl or heteroaryl portion often are the same as those described above for aryl groups generally.

"Arylalkyl" groups as used herein are hydrocarbyl groups if they are unsubstituted, and are described by the total number of carbon atoms in the ring and alkylene or similar linker. Thus a benzyl group is a C7-arylalkyl group, and phenylethyl is a C8-arylalkyl.

"Heteroarylalkyl" as described above refers to a moiety comprising an aryl group that is attached through a linking group, and differs from "arylalkyl" in that at least one ring atom of the aryl moiety or one atom in the linking group is a heteroatom selected from N, O and S. The heteroarylalkyl groups are described herein according to the total number of atoms in the ring and linker combined, and they include aryl groups linked through a heteroalkyl linker; heteroaryl groups linked through a hydrocarbyl linker such as an alkylene; and heteroaryl groups linked through a heteroalkyl linker. Thus, for example, C7-heteroarylalkyl includes pyridylmethyl, phenoxy, and N-pyrrolylmethoxy.

"Alkylene" as used herein refers to a divalent hydrocarbyl group. Because an alkylene is divalent, it can link two other groups together. An alkylene often is referred to as —$(CH_2)_n$— where n can be 1-20, 1-10, 1-8, or 1-4, though where specified, an alkylene can also be substituted by other groups, and can be of other lengths, and the open valences need not be at opposite ends of a chain. Thus —CH(Me)- and —$C(Me)_2$- may also be referred to as alkylenes, as can a cyclic group such as cyclopropan-1,1-diyl. Where an alkylene group is substituted, the substituents include those typically present on alkyl groups as described herein.

In some embodiments, a feedstock includes a mixture of carbon sources, where each carbon source in the feedstock is selected based on the genotype of the engineered microorganism. In certain embodiments, a mixed carbon source feedstock includes one or more carbon sources selected from sugars, cellulose, alkanes, fatty acids, triacylglycerides, paraffins, the like and combinations thereof.

Nitrogen may be supplied from an inorganic (e.g., $(NH_4)_2SO_4$) or organic source (e.g., urea or glutamate). In addition to appropriate carbon and nitrogen sources, culture media also can contain suitable minerals, salts, cofactors, buffers, vitamins, metal ions (e.g., $Mn^{+2}$, $Co^{+2}$, $Zn^{+2}$, $Mg^{+2}$) and other components suitable for culture of microorganisms.

Engineered microorganisms sometimes are cultured in complex media (e.g., yeast extract-peptone-dextrose broth (YPD)). In some embodiments, engineered microorganisms are cultured in a defined minimal media that lacks a component necessary for growth and thereby forces selection of a desired expression cassette (e.g., Yeast Nitrogen Base (DIFCO Laboratories, Detroit, Mich.)).

Culture media in some embodiments are common commercially prepared media, such as Yeast Nitrogen Base (DIFCO Laboratories, Detroit, Mich.). Other defined or synthetic growth media may also be used and the appropriate medium for growth of the particular microorganism are known. A variety of host organisms can be selected for the production of engineered microorganisms. Non-limiting examples include yeast (e.g., *Candida tropicalis* (e.g., ATCC20336, ATCC20913, ATCC20962), *Yarrowia lipolytica* (e.g., ATCC20228)) and filamentous fungi (e.g., *Aspergillus nidulans* (e.g., ATCC38164) and *Aspergillus parasiticus* (e.g., ATCC 24690)). In specific embodiments, yeast are cultured in YPD media (10 g/L Bacto Yeast Extract, 20 g/L Bacto Peptone, and 20 g/L Dextrose). Filamentous fungi, in particular embodiments, are grown in CM (Complete Medium) containing 10 g/L Dextrose, 2 g/L Bacto Peptone, 1 g/L Bacto Yeast Extract, 1 g/L Casamino acids, 50 mL/L 20× Nitrate Salts (120 g/L $NaNO_3$, 10.4 g/L KCl, 10.4 g/L MgSO$_4$.7H$_2$O), 1 mL/L 1000× Trace Elements (22 g/L ZnSO$_4$.7H$_2$O, 11 g/L H$_3$BO$_3$, 5 g/L MnCl$_2$.7H$_2$O, 5 g/L FeSO$_4$.7H$_2$O, 1.7 g/L CoCl$_2$.6H$_2$O, 1.6 g/L CuSO$_4$.5H$_2$O, 1.5 g/L Na$_2$MoO$_4$.2H$_2$O, and 50 g/L Na$_4$EDTA), and 1 mL/L Vitamin Solution (100 mg each of Biotin, pyridoxine, thiamine, riboflavin, p-aminobenzoic acid, and nicotinic acid in 100 mL water).

In those embodiments in which a feedstock comprising an unsaturated fatty acid or ester thereof is employed, the resulting diacid may be unsaturated as well. If a saturated diacid is desired as the final product, the unsaturated diacid may be hydrogenated to remove one or all carbon-carbon double bonds. Hydrogenation may be accomplished using methods known in the art. The addition of hydrogen across the double bond can be accomplished with metallic chemical catalysts, non-metallic chemical catalysts, or enzymatic catalysts. The source of hydrogen may be molecular hydrogen in the case of chemical catalysis or enzymatic cofactors (ie. NADH, NADPH, FADH$_2$) in the case of enzymatic catalysis.

Catalytic hydrogenation with metallic catalysts may take advantage of many different types of catalysts. The metal may be platinum, palladium, rhodium, ruthenium, nickel, or other metals. The catalysts may be homogenous or heterogeneous catalysts. Elevated temperatures and pressures may be employed to increase the reaction rate. Catalytic hydrogenation may also occur with nonmetallic catalysts such as frustrated Lewis pair compounds.

Enzymatic hydrogenation may occur in vivo or in vitro with native or engineered enzymes that catalyze redox reactions that use unsaturated diacids or fatty acids as a substrate or a product. Examples of such enzymes are acyl-CoA dehydrogenase (EC#1.3.1.8), trans-2-enoyl-CoA reductase (EC#1.3.1.44), or stearoyl-CoA 9-desaturase (EC#1.14.19.1). In some instances, the desired reaction producing a saturated diacid may actually require the enzyme to operate in the reverse direction from its normal in vivo reaction; such reversal can be accomplished via genetic manipulation of the enzyme.

Growth Conditions & Fermentation

A suitable pH range for the fermentation often is between about pH 4.0 to about pH 8.0, where a pH in the range of about pH 5.5 to about pH 7.0 sometimes is utilized for initial culture conditions. Depending on the host organism, culturing may be conducted under aerobic or anaerobic conditions, where microaerobic conditions sometimes are maintained. A two-stage process may be utilized, where one stage promotes microorganism proliferation and another state promotes production of target molecule. In a two-stage process, the first stage may be conducted under aerobic conditions (e.g., introduction of air and/or oxygen) and the second stage may be conducted under anaerobic conditions (e.g., air or oxygen are not introduced to the culture conditions). In some embodiments, the first stage may be conducted under anaerobic conditions and the second stage may be conducted under aerobic conditions. In certain embodiments, a two-stage process may include two more organisms, where one organism generates an intermediate product in one stage and another organism processes the intermediate product into a target fatty dicarboxylic acid product (e.g., sebacic or dodecanedioic acid) in another stage, for example.

A variety of fermentation processes may be applied for commercial biological production of a target fatty dicarboxylic acid product. In some embodiments, commercial production of a target fatty dicarboxylic acid product from a recombinant microbial host is conducted using a batch, fed-batch or continuous fermentation process, for example.

A batch fermentation process often is a closed system where the media composition is fixed at the beginning of the process and not subject to further additions beyond those required for maintenance of pH and oxygen level during the process. At the beginning of the culturing process the media is inoculated with the desired organism and growth or metabolic activity is permitted to occur without adding additional sources (i.e., carbon and nitrogen sources) to the medium. In batch processes the metabolite and biomass compositions of the system change constantly up to the time the culture is terminated. In a typical batch process, cells proceed through a static lag phase to a high-growth log phase and finally to a stationary phase, wherein the growth rate is diminished or halted. Left untreated, cells in the stationary phase will eventually die.

A variation of the standard batch process is the fed-batch process, where the carbon source is continually added to the fermentor over the course of the fermentation process. Fed-batch processes are useful when catabolite repression is apt to inhibit the metabolism of the cells or where it is desirable to have limited amounts of carbon source in the media at any one time. Measurement of the carbon source concentration in fed-batch systems may be estimated on the basis of the changes of measurable factors such as pH, dissolved oxygen and the partial pressure of waste gases (e.g., CO.sub.2).

Batch and fed-batch culturing methods are known in the art. Examples of such methods may be found in Thomas D. Brock in Biotechnology: A Textbook of Industrial Microbiology, 2.sup.nd ed., (1989) Sinauer Associates Sunderland, Mass. and Deshpande, Mukund V., Appl. Biochem. Biotechnol., 36:227 (1992).

In continuous fermentation process a defined media often is continuously added to a bioreactor while an equal amount of culture volume is removed simultaneously for product recovery. Continuous cultures generally maintain cells in the log phase of growth at a constant cell density. Continuous or semi-continuous culture methods permit the modulation of one factor or any number of factors that affect cell growth or end product concentration. For example, an approach may limit the carbon source and allow all other parameters to moderate metabolism. In some systems, a number of factors affecting growth may be altered continuously while the cell concentration, measured by media turbidity, is kept constant. Continuous systems often maintain steady state growth and thus the cell growth rate often is balanced against cell loss due to media being drawn off the culture. Methods of modulating nutrients and growth factors for continuous culture processes, as well as techniques for maximizing the rate of product formation, are known and a variety of methods are detailed by Brock, supra.

In some embodiments involving fermentation, the fermentation can be carried out using two or more microorganisms (e.g., host microorganism, engineered microorganism, isolated naturally occurring microorganism, the like and combinations thereof), where a feedstock is partially or completely utilized by one or more organisms in the fermentation (e.g., mixed fermentation), and the products of cellular respiration or metabolism of one or more organisms can be further metabolized by one or more other organisms to produce a desired target product (e.g., sebacic acid, dodecanedioic acid, hexanoic acid). In certain embodiments, each organism can be fermented independently and the products of cellular respiration or metabolism purified and contacted with another organism to produce a desired target product. In some embodiments, one or more organisms are partially or completely blocked in a metabolic pathway (e.g., beta oxidation, omega oxidation, the like or combinations thereof), thereby producing a desired product that can be used as a feedstock for one or more other organisms. Any suitable combination of microorganisms can be utilized to carry out mixed fermentation or sequential fermentation.

Enhanced Fermentation Processes

It has been determined that certain feedstock components are toxic to, or produce a by-product (e.g., metabolite) that is toxic to, yeast utilized in a fermentation process for the purpose of producing a target product (e.g., a C4 to C24 diacid). A toxic component or metabolite from a feedstock sometimes is utilized by the yeast to produce a target product (e.g., target molecule).

In some instances, a fatty acid component having 12 carbons (i.e., C12) or fewer carbons can be toxic to yeast. Components that are not free fatty acids, but are processed by yeast to a fatty acid having twelve or fewer carbons, also can have a toxic effect. Non-limiting examples of such components are esters of fatty acids (e.g., methyl esters) that are processed by yeast into a fatty acid having twelve or fewer carbons. Feedstocks containing molecules that are directly toxic, or indirectly toxic by conversion of a non-toxic component to a toxic metabolite, are collectively referred to as "toxic feedstocks" and "toxic components." Providing yeast with a feedstock that comprises or delivers one or more toxic components can reduce the viability of the yeast and/or reduce the amount of target product produced by the yeast.

In some embodiments, a process for overcoming the toxic effect of certain components in a feedstock includes first inducing yeast with a feedstock not containing a substantially toxic component and then providing the yeast with a feedstock that comprises a toxic component. Thus, in some embodiments, provided is a method for producing a diacid by a yeast from a feedstock toxic to the yeast, comprising: (a) contacting a genetically modified yeast in culture with a first feedstock comprising a component not substantially toxic to the yeast, thereby performing an induction; and (b) contacting the yeast after the induction in (a) with a second feedstock that comprises or delivers a component toxic to the yeast ("toxic component"), whereby a diacid is produced by the yeast in an amount greater than the amount of the diacid produced when the induction is not performed.

A toxic component provided by the second feedstock sometimes is processed by the yeast into a target product (e.g., diacid). Sometimes a component not substantially toxic to the yeast in the first feedstock (e.g., an inducer) is processed by the yeast into a target product or byproduct (e.g., diacid containing a different number of carbons than the target product). The first feedstock sometimes comprises a component not substantially toxic to the yeast having the same number of carbons as the component in the second feedstock, or a metabolite processed by the yeast from a component in the second feedstock, that is substantially toxic to the yeast. In some embodiments, the first feedstock comprises a component not substantially toxic to the yeast having a different number of carbons as the component in the second feedstock, or a metabolite processed by yeast from a component in the second feedstock, that is substantially toxic to the yeast. In certain embodiments, the first feedstock comprises a component that is not substantially toxic to the yeast (e.g., an inducer) that has the same number of carbons as the target product. Sometimes the first feedstock comprises a component not substantially toxic to the yeast (e.g., an inducer) that has a different number of carbons as the target product (e.g., diacid).

In some embodiments, the first feedstock comprises an ester of a fatty acid that is not substantially toxic to the yeast (e.g., methyl ester), and sometimes the fatty acid has more than 12 carbons. The first feedstock sometimes comprises a fatty acid that is not substantially toxic to the yeast, and in some cases the fatty acid has more than 12 carbons. The first feedstock sometimes comprises a triglyceride, which triglyceride often contains various chain-length fatty acids, that is not substantially toxic to the yeast. In certain cases the first feedstock comprises an aliphatic chain, which aliphatic chain often contains more than 6 carbons, that is not substantially toxic to the yeast. In some embodiments, the first feedstock comprises one or more alkanes (e.g., linear alkanes, branched alkanes, substituted alkanes) with chain lengths greater than 6 carbons. In some embodiments a target product is a C12 diacid, the first feedstock comprises an alkane (e.g., alkane inducer) and the second feedstock comprises a C12 fatty acid or an ester of a C12 fatty acid, where the alkane sometimes is a C12 alkane. In some embodiments a target product is a C10 diacid, the first feedstock comprises an alkane (e.g., alkane inducer) and the second feedstock comprises a C10 fatty acid or an ester of a C10 fatty acid, where the alkane sometimes is a C10 alkane. In some embodiments a target product is a C18 diacid, the first feedstock comprises an alkane (e.g., alkane inducer) and the second feedstock comprises a C18 fatty acid or an ester of a C18 fatty acid, where the alkane sometimes is a C18 alkane. In certain embodiments, one or more of the (i) components in the first feedstock and/or the second feedstock and (ii) products (e.g., target product) are saturated. In some embodiments, one or more of the (i) components in the first feedstock and/or the second feedstock and (ii) products (e.g., target product) include one or more unsaturations (e.g., one or more double bonds).

In some embodiments, the second feedstock is provided to the yeast a certain amount of time after the first feedstock is provided to the yeast. The amount of time sometimes is about 1 hour to about 48 hours, sometimes is about 1 hour to about 12 hours (e.g., about 2 hours, 3, hours, 4, hours, 5, hours, 6 hours, 7 hours, 8, hours, 9 hours, 10 hours or 11 hours), and sometimes is about 3 hours to about 9 hours. In some embodiments, the yeast is a *Candida* spp. yeast, or another yeast described herein.

Target Product Production, Isolation and Yield

In various embodiments a fatty dicarboxylic acid (e.g., octanedioic acid, decanedioic acid, dodecanedioic acid, tetradecanedioic acid, hexadecanedioic acid, octadecanedioic acid, eicosanedioic acid) is isolated or purified from the culture media or extracted from the engineered microorganisms. In some embodiments, fermentation of feedstocks by methods described herein can produce a target fatty dicarboxylic acid product (e.g., sebacic or dodecanedioic acid) at a level of about 10% to about 100% of theoretical yield (e.g., about 15%, about 20%, about 25% or more of theoretical yield (e.g., 25% or more, 26% or more, 27% or more, 28% or more, 29% or more, 30% or more, 31% or more, 32% or more, 33% or more, 34% or more, 35% or more, 36% or more, 37% or more, 38% or more, 39% or more, 40% or more, 41% or more, 42% or more, 43% or more, 44% or more, 45% or more, 46% or more, 47% or more, 48% or more, 49% or more, 50% or more, 51% or more, 52% or more, 53% or more, 54% or more, 55% or more, 56% or more, 57% or more, 58% or more, 59% or more, 60% or more, 61% or more, 62% or more, 63% or more, 64% or more, 65% or more, 66% or more, 67% or more, 68% or more, 69% or more, 70% or more, 71% or more, 72% or more, 73% or more, 74% or more, 75% or more, 76% or more, 77% or more, 78% or more, 79% or more, 80% or more, 81% or more, 82% or more, 83% or more, 84% or more, 85% or more, 86% or more, 87% or more, 88% or more, 89% or more, 90% or more, 91% or more, 92% or more, 93% or more, 94% or more, 95% or more, 96% or more, 97% or more, 98% or more, or 99% or more of theoretical yield). The term "theoretical yield" as used herein refers to the amount of product that could be made from a starting material if the reaction is 100% complete. Theoretical yield is based on the stoichiometry of a reaction and ideal conditions in which starting material is completely consumed, undesired side reactions do not occur, the reverse reaction does not occur, and there are no losses in the work-up procedure. Culture media may be tested for target product (e.g., sebacic or dodecanedioic acid) concentration and drawn off when the concentration reaches a predetermined level. Detection methods are known in the art, including but not limited to chromatographic methods (e.g., gas chromatography) or combined chromatographic/mass spectrometry (e.g., GC-MS) methods. Target product (e.g., sebacic or dodecanedioic acid) may be present at a range of levels as described herein.

A target fatty dicarboxylic acid product sometimes is retained within an engineered microorganism after a culture process is completed, and in certain embodiments, the target product is secreted out of the microorganism into the culture medium. For the latter embodiments, (i) culture media may be drawn from the culture system and fresh medium may be supplemented, and/or (ii) target product may be extracted from the culture media during or after the culture process is completed. Engineered microorganisms may be cultured on or in solid, semi-solid or liquid media. In some embodiments media is drained from cells adhering to a plate. In certain embodiments, a liquid-cell mixture is centrifuged at a speed sufficient to pellet the cells but not disrupt the cells and allow extraction of the media, as known in the art. The cells may then be resuspended in fresh media. Target product may be purified from culture media according to known methods know in the art.

In some embodiments, a target diacid is present in a product containing other diacids and/or byproducts. The target diacid can be purified from the other diacids and/or byproducts using a suitable purification procedure. A partially purified or substantially purified target diacid may be produced using a purification process.

Provided herein are non-limiting examples of methods useful for recovering target product from fermentation broth and/or isolating/partially purifying a target fatty dicarboxylic acid product from non-target products when utilizing mixed chain length feedstocks. Recovery of a fatty dicarboxylic acid (e.g., octanedioic acid, decanedioic acid, dodecanedioic acid, tetradecanedioic acid, hexadecanedioic acid, octadecanedioic acid, eicosanedioic acid) from fermentation broth can be accomplished using a variety of methods. Optionally, one can first employ a centrifugation step to separate cell mass and a fatty dicarboxylic acid (e.g., octanedioic acid, decanedioic acid, dodecanedioic acid, tetradecanedioic acid, hexadecanedioic acid, octadecanedioic acid, eicosanedioic acid) from the aqueous phase. A fatty dicarboxylic acid (e.g., octanedioic acid, decanedioic acid, dodecanedioic acid, tetradecanedioic acid, hexadecanedioic acid, octadecanedioic acid, eicosanedioic acid) has limited solubility in water under fermentation conditions, and has a density similar to that of water. Upon centrifugation, the majority of fatty dicarboxylic acid (e.g., octanedioic acid, decanedioic acid, dodecanedioic acid, tetradecanedioic acid, hexadecanedioic acid, octadecanedioic acid, eicosanedioic acid) will be pulled away from the water stream, and be concentrated in the cell mass stream. The concentrated fatty dicarboxylic acid stream will then be further concentrated via filtration steps (e.g., solid dodecanedioic acid will be retained on a filter, allowing water to pass through, concentrating the product). Once the fatty dicarboxylic acid (e.g., octanedioic acid, decanedioic acid, dodecanedioic acid, tetradecanedioic acid, hexadecanedioic acid, octadecanedioic acid, eicosanedioic acid) is concentrated to the desired level, the temperature will be increased to above its melting point of 130° C. After the fatty dicarboxylic acid is melted, the remaining impurities are removed via filtration; the final product is recovered by decreasing the temperature, allowing the fatty dicarboxylic acid to solidify, and collecting the solid product.

Alternatively, a fatty dicarboxylic acid (e.g., octanedioic acid, decanedioic acid, dodecanedioic acid, tetradecanedioic acid, hexadecanedioic acid, octadecanedioic acid, eicosanedioic acid) can be recovered from fermentation broth by first extracting the broth with an organic solvent in which a fatty dicarboxylic acid (e.g., octanedioic acid, decanedioic acid, dodecanedioic acid, tetradecanedioic acid, hexadecanedioic acid, octadecanedioic acid, eicosanedioic acid) is soluble (e.g., ethanol). The organic solvent phase can then be filtered through various membranes to further purify the fatty dicarboxylic acid. Subsequent extractions with the same or a different organic solvent can then be performed and each round of extraction can be followed by membrane filtration to further concentrate the fatty dicarboxylic acid. The organic solvent can be evaporated, leaving the fatty dicarboxylic acid behind as a residue and the residue can be dried to provide the fatty dicarboxylic acid (e.g., octanedioic acid, decanedioic acid, dodecanedioic acid, tetradecanedioic acid, hexadecanedioic acid, octadecanedioic acid, eicosanedioic acid) in solid form.

In certain embodiments, target product is extracted from the cultured engineered microorganisms. The microorganism cells may be concentrated through centrifugation at a speed sufficient to shear the cell membranes. In some embodiments, the cells may be physically disrupted (e.g., shear force, sonication) or chemically disrupted (e.g., contacted with detergent or other lysing agent). The phases may be separated by centrifugation or other method known in the art and target product may be isolated according to known methods.

Commercial grade target product sometimes is provided in substantially pure form (e.g., 90% pure or greater, 95% pure or greater, 99% pure or greater or 99.5% pure or greater). In some embodiments, target product may be modified into any one of a number of downstream products. For example, a fatty dicarboxylic acid (e.g., octanedioic acid, decanedioic acid, dodecanedioic acid, tetradecanedioic acid, hexadecanedioic acid, octadecanedioic acid, eicosanedioic acid) may be polycondensed with hexamethylenediamine to produce nylon. Nylon may be further processed into fibers for applications in carpeting, automobile tire cord and clothing. A fatty dicarboxylic acid (e.g., octanedioic acid, decanedioic acid, dodecanedioic acid, tetradecanedioic acid, hexadecanedioic acid, octadecanedioic acid, eicosanedioic acid) is also used for manufacturing plasticizers, lubricant components and polyester polyols for polyurethane systems. Various esters of food grade fatty dicarboxylic acids (e.g., octanedioic acid, decanedioic acid, dodecanedioic acid, tetradecanedioic acid, hexadecanedioic acid, octadecanedioic acid, eicosanedioic acid) are used as components in fragrance manufacture, gelling aids, flavorings, acidulant, leavening and buffering agent. A fatty dicarboxylic acid (e.g., octanedioic acid, decanedioic acid, dodecanedioic acid, tetradecanedioic acid, hexadecanedioic acid, octadecanedioic acid, eicosanedioic acid) has two carboxylic acid (—COOH) groups, which can yield two kinds of salts. Its derivatives, acyl halides, anhydrides, esters, amides and nitriles, are used in making a variety of downstream products through further reactions of substitution, catalytic reduction, metal hydride reduction, diborane reduction, keto formation with organometallic reagents, electrophile bonding at oxygen, and condensation.

Target product may be provided within cultured microbes containing target product, and cultured microbes may be supplied fresh or frozen in a liquid media or dried. Fresh or frozen microbes may be contained in appropriate moisture-proof containers that may also be temperature controlled as necessary. Target product sometimes is provided in culture medium that is substantially cell-free. In some embodiments target product or modified target product purified from microbes is provided, and target product sometimes is provided in substantially pure form. In certain embodiments crystallized or powdered target product is provided. Dodecanedioic acid (1,12 dodecanedioic acid; DDDA) is a white powder or crystal with a melting point of between 260° F. and 266° F. Sebacic acid (1,8 ocatanedicarboxylic acid) is also a white powder or crystal with a melting point of between 268° F. and 274° F. A crystallized or powdered fatty dicarboxylic acid (e.g., octanedioic acid, decanedioic acid, dodecanedioic acid, tetradecanedioic acid, hexadecanedioic acid, octadecanedioic acid, eicosanedioic acid) may be transported in a variety of containers including one ton cartons, drums, 50 pound bags and the like.

In certain embodiments, a fatty dicarboxylic acid target product (e.g., dodecanedioic acid or sebacic acid) is produced with a yield of about 0.50 grams of target product per gram of feedstock added, or greater; 0.51 grams of target product per gram of feedstock added, or greater; 0.52 grams of target product per gram of feedstock added, or greater; 0.53 grams of target product per gram of feedstock added, or greater; 0.54 grams of target product per gram of feedstock added, or greater; 0.55 grams of target product per gram of feedstock added, or greater; 0.56 grams of target product per gram of feedstock added, or greater; 0.57 grams of target product per gram of feedstock added, or greater; 0.58 grams of target product per gram of feedstock added, or greater; 0.59 grams of target product per gram of feedstock added, or greater; 0.60 grams of target product per gram of feedstock added, or greater; 0.61 grams of target product per gram of feedstock added, or greater; 0.62 grams of target product per gram of feedstock added, or greater; 0.63 grams of target product per gram of feedstock added, or greater; 0.64 grams of target product per gram of feedstock added, or greater; 0.65 grams of target product per gram of feedstock added, or greater; 0.66 grams of target product per gram of feedstock added, or greater; 0.67 grams of target product per gram of feedstock added, or greater; 0.68 grams of target product per gram of feedstock added, or greater; 0.69 grams of target product per gram of feedstock added, or greater; 0.70 grams of target product per gram of feedstock added or greater; 0.71 grams of target product per gram of feedstock added, or greater; 0.72 grams of target product per gram of feedstock added, or greater; 0.73 grams of target product per gram of feedstock added, or greater; 0.74 grams of target product per gram of feedstock added, or greater; 0.75 grams of target product per gram of feedstock added, or greater; 0.76 grams of target product per gram of feedstock added, or greater; 0.77 grams of target product per gram of feedstock added, or greater; 0.78 grams of target product per gram of feedstock added, or greater; 0.79 grams of target product per gram of feedstock added, or greater; 0.80 grams of target product per gram of feedstock added, or greater; 0.81 grams of target product per gram of feedstock added, or greater; 0.82 grams of target product per gram of feedstock added, or greater; 0.83 grams of target product per gram of feedstock added, or greater; 0.84 grams of target product per gram of feedstock added, or greater; 0.85 grams of target product per gram of feedstock added, or greater; 0.86 grams of target product per gram of feedstock added, or greater; 0.87 grams of target product per gram of feedstock added, or greater; 0.88 grams of target product per gram of feedstock added, or greater; 0.89 grams of target product per gram of feedstock added, or greater; 0.90 grams of target product per gram of feedstock added, or greater; 0.91 grams of target product per gram of feedstock added, or greater; 0.92 grams of target product per gram of feedstock added, or greater; 0.93 grams of target product per gram of feedstock added, or greater; 0.94 grams of target product per gram of feedstock added, or greater; 0.95 grams of target product per gram of feedstock added, or greater; 0.96 grams of target product per gram of feedstock added, or greater; 0.97 grams of target product per gram of feedstock added, or greater; 0.98 grams of target product per gram of feedstock added, or greater; 0.99 grams of target product per gram of feedstock added, or greater; 1.0 grams of target product per gram of feedstock added, or greater; 1.1 grams of target product per gram of feedstock added, or greater; 1.2 grams of target product per gram of feedstock added, or greater; 1.3 grams of target product per gram of feedstock added, or greater; 1.4 grams of target product per gram of feedstock added, or greater; or about 1.5 grams of target product per gram of feedstock added, or greater.

In certain embodiments, a fatty dicarboxylic acid (e.g., octanedioic acid, decanedioic acid, dodecanedioic acid, tetradecanedioic acid, hexadecanedioic acid, octadecanedioic acid, eicosanedioic acid) is produced with a yield of greater than about 0.15 grams per gram of the feedstock (e.g., dodecane, mixed chain length alkanes, lauric acid, mixed chain length fatty acids, oil, the like or combinations of the foregoing). In some embodiments, a fatty dicarboxylic acid (e.g., octanedioic acid, decanedioic acid, dodecanedioic acid, tetradecanedioic acid, hexadecanedioic acid, octadecanedioic acid, eicosanedioic acid) is produced at between about 10% and about 100% of maximum theoretical yield of any introduced feedstock ((e.g., about 15%, about 20%, about 25% or more of theoretical yield (e.g., 25% or more, 26% or more, 27% or more, 28% or more, 29% or more, 30% or more, 31% or more, 32% or more, 33% or more, 34% or more, 35% or more, 36% or more, 37% or more, 38% or more, 39% or more, 40% or more, 41% or more, 42% or more, 43% or more, 44% or more, 45% or more, 46% or more, 47% or more, 48% or more, 49% or more, 50% or more, 51% or more, 52% or more, 53% or more, 54% or more, 55% or more, 56% or more, 57% or more, 58% or more, 59% or more, 60% or more, 61% or more, 62% or more, 63% or more, 64% or more, 65% or more, 66% or more, 67% or more, 68% or more, 69% or more, 70% or more, 71% or more, 72% or more, 73% or more, 74% or more, 75% or more, 76% or more, 77% or more, 78% or more, 79% or more, 80% or more, 81% or more, 82% or more, 83% or more, 84% or more, 85% or more, 86% or more, 87% or more, 88% or more, 89% or more, 90% or more, 91% or more, 92% or more, 93% or more, 94% or more, 95% or more, 96% or more, 97% or more, 98% or more, or 99% or more of theoretical maximum yield). In certain embodiments, a fatty dicarboxylic acid (e.g., octanedioic acid, decanedioic acid, dodecanedioic acid, tetradecanedioic acid, hexadecanedioic acid, octadecanedioic acid, eicosanedioic acid) is produced in a concentration range of between about 50 g/L to about 1000 g/L of culture media (e.g., about 50 g/L, about 55 g/L, about 60 g/L, about 65 g/L, about 70 g/L, about 75 g/L, about 80 g/L, about 85 g/L, about 90 g/L, about 95 g/L, about 100 g/L, about 110 g/L, about 120 g/L, about 130 g/L, about 140 g/L, about 150 g/L, about 160 g/L, about 170 g/L, about 180 g/L, about 190 g/L, about 200 g/L, about 225 g/L, about 250 g/L, about 275 g/L, about 300 g/L, about 325 g/L, about 350 g/L, about 375 g/L, about 400 g/L, about 425 g/L, about 450 g/L, about 475 g/L, about 500 g/L, about 550 g/L, about 600 g/L, about 650 g/L, about 700 g/L, about 750 g/L, about 800 g/L, about 850 g/L, about 900 g/L, about 950 g/L, or about 1000 g/L).

In some embodiments, a fatty dicarboxylic acid (e.g., octanedioic acid, decanedioic acid, dodecanedioic acid, tetradecanedioic acid, hexadecanedioic acid, octadecanedioic acid, eicosanedioic acid) is produced at a rate of between about 0.5 g/L/hour to about 5 g/L/hour (e.g., about 0.5 g/L/hour, about 0.6 g/L/hour, about 0.7 g/L/hour, about 0.8 g/L/hour, about 0.9 g/L/hour, about 1.0 g/L/hour, about 1.1 g/L/hour, about 1.2 g/L/hour, about 1.3 g/L/hour, about 1.4 g/L/hour, about 1.5 g/L/hour, about 1.6 g/L/hour, about 1.7 g/L/hour, about 1.8 g/L/hour, about 1.9 g/L/hour, about 2.0 g/L/hour, about 2.25 g/L/hour, about 2.5 g/L/hour, about 2.75 g/L/hour, about 3.0 g/L/hour, about 3.25 g/L/hour, about 3.5 g/L/hour, about 3.75 g/L/hour, about 4.0 g/L/hour, about 4.25 g/L/hour, about 4.5 g/L/hour, about 4.75 g/L/hour, or about 5.0 g/L/hour.) In certain, embodiments, the engineered organism comprises between about a 5-fold to about a 500-fold increase in a fatty dicarboxylic acid (e.g., octanedioic acid, decanedioic acid, dodecanedioic acid, tetradecanedioic acid, hexadecanedioic acid, octadecanedioic acid, eicosanedioic acid) production when compared to wild-type or partially engineered organisms of the same strain, under identical fermentation conditions (e.g., about a 5-fold increase, about a 10-fold increase, about a 15-fold increase, about a 20-fold increase, about a 25-fold increase, about a 30-fold increase, about a 35-fold increase, about a 40-fold increase, about a 45-fold increase, about a 50-fold increase, about a 55-fold increase, about a 60-fold increase, about a 65-fold increase, about a 70-fold increase, about a 75-fold increase, about a 80-fold increase, about a 85-fold increase, about a 90-fold increase, about a 95-fold increase, about a 100-fold increase, about a 125-fold increase, about a 150-fold increase, about a 175-fold increase, about a 200-fold increase, about a 250-fold increase, about a 300-fold increase, about a 350-fold increase, about a 400-fold increase, about a 450-fold increase, or about a 500-fold increase).

In certain embodiments, the maximum theoretical yield ($Y_{max}$) of dodecanedioic acid in a fully beta-oxidation blocked engineered microorganism is about 1.15 grams of dodecanedioic acid produced per gram of lauric acid added. In some embodiments, the maximum theoretical yield ($Y_{max}$) of dodecanedioic acid in a fully beta-oxidation blocked engineered microorganism is about 1.07 grams of dodecanedioic acid produced per gram of methyl laurate added. In certain embodiments, the maximum theoretical yield ($Y_{max}$) of dodecanedioic acid in a partially beta-oxidation blocked engineered microorganism is about 0.82 grams of dodecanedioic acid produced per gram of oleic acid added. In some embodiments, the maximum theoretical yield ($Y_{max}$) of dodecanedioic acid in a partially beta-oxidation blocked engineered microorganism is about 0.95 grams of dodecanedioic acid produced per gram of coconut oil added. The percentage of $Y_{max}$ for the engineered microorganism under conditions in which dodecanedioic acid is produced is calculated as (% $Y_{max}$)=$Y_{p/s}$/$Y_{max}$*100, where ($Y_{p/s}$)=[dodecanedioic acid (g/L)]*final volume of culture in flask (L)]/[feedstock added to flask (g)]. In some embodiments, the engineered microorganism produces dodecanedioic acid at about 10% to about 100% of maximum theoretical yield.

In certain embodiments, the maximum theoretical yield ($Y_{max}$) of sebacic acid in a fully beta-oxidation blocked engineered microorganism is about 1.42 grams of sebacic acid produced per gram of decane added. In some embodiments, the maximum theoretical yield ($Y_{max}$) of sebacic acid in a fully beta-oxidation blocked engineered microorganism is about 1.17 grams of sebacic acid produced per gram of capric acid added. In certain embodiments, the maximum theoretical yield ($Y_{max}$) of sebacic acid in a partially beta-oxidation blocked engineered microorganism is about 0.83 grams of sebacic acid produced per gram of coconut oil added. In some embodiments, the maximum theoretical yield ($Y_{max}$) of sebacic acid in a partially beta-oxidation blocked engineered microorganism is about 0.72 grams of sebacic acid produced per gram of oleic acid added. The percentage of $Y_{max}$ for the engineered microorganism under conditions in which sebacic acid is produced is calculated as (% $Y_{max}$)=$Y_{p/s}$/$Y_{max}$*100, where ($Y_{p/s}$)=[sebacic acid (g/L)]*final volume of culture in flask (L)]/[feedstock added to flask (g)]. In some embodiments, the engineered microorganism produces sebacic acid at about 10% to about 100% of maximum theoretical yield.

EXAMPLES

The examples set forth below illustrate certain embodiments and do not limit the technology. Certain examples set forth below utilize standard recombinant DNA and other biotechnology protocols known in the art. Many such techniques are described in detail in Maniatis, T., E. F. Fritsch and J. Sambrook (1982) *Molecular Cloning: a Laboratory Manual*; Cold Spring Harbor Laboratory, Cold Spring Harbor, N.Y. DNA mutagenesis can be accomplished using the Stratagene (San Diego, Calif.) "QuickChange" kit according to the manufacturer's instructions.

Non-limiting examples of recombinant DNA techniques and genetic manipulation of microorganisms are described herein. In some embodiments, strains of engineered organisms described herein are mated to combine genetic backgrounds to further enhance carbon flux management through native and/or engineered pathways described herein, for the production of a desired target product (e.g., sebacic or dodecanedioic acid).

Figure 9:
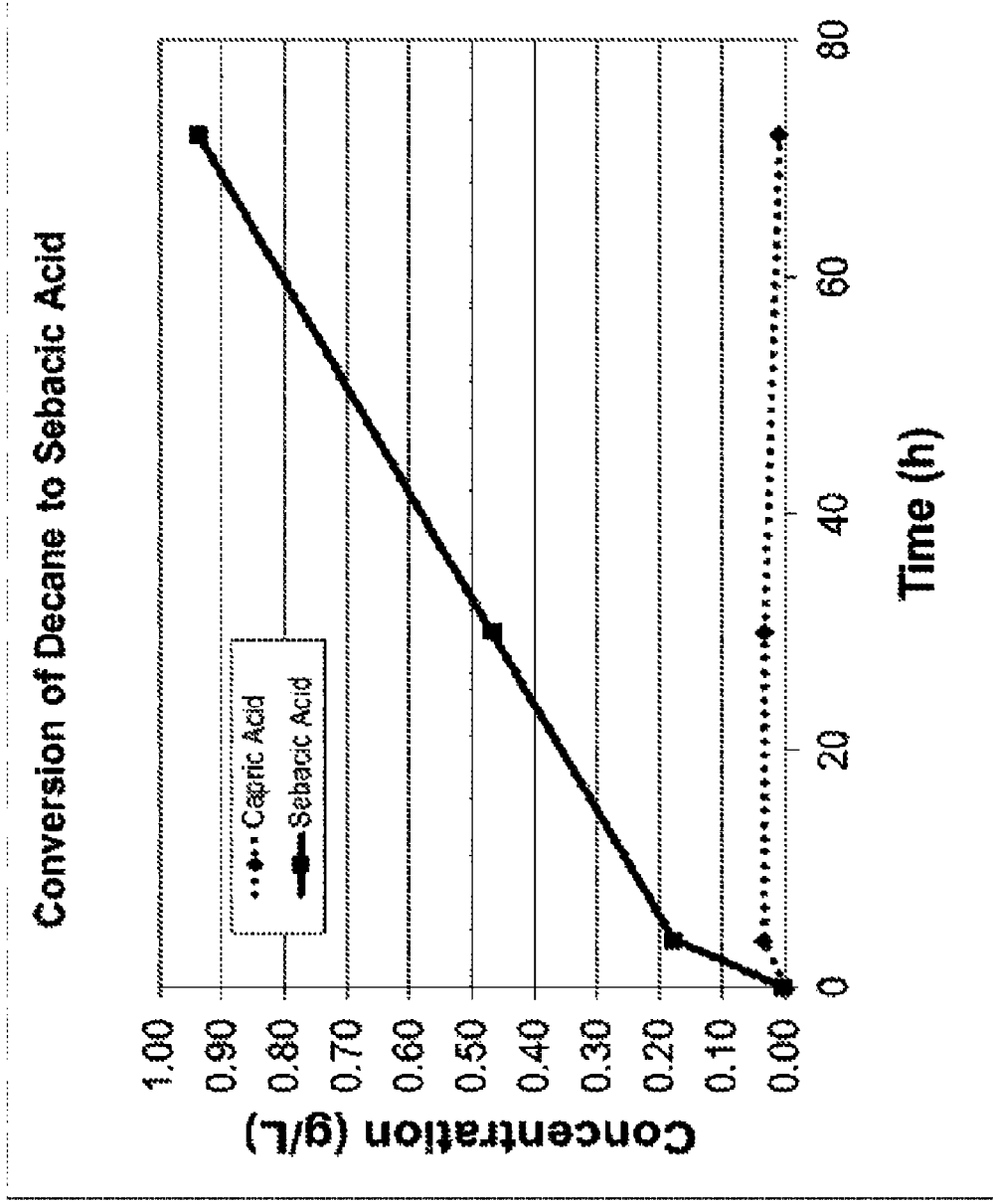
FIG. 9 graphically illustrates the conversion of decane to sebacic acid in a fully beta-oxidation blocked *C. tropicalis* yeast strain. After incubation for the times shown in the graph, the media was subjected to gas chromatography. The results indicate that greater than 99% of the decane was converted into sebacic acid, with a minimal amount of capric acid also detected by gas chromatography. No significant accumulation of any other monoacid or diacid was detected by gas chromatography. Experimental details and results are given in Example 1.

Example 1: Conversion of Decane to Sebacic Acid in Shake Flask Fermentation 50 mL of SP92 medium (6.7 g/L yeast nitrogen base, 3.0 g/L yeast extract, 3.0 g/L $(NH_4)_2SO_4$, 1.0 g/L $K_2HPO_4$, 1.0 g/L $KH_2PO_4$, 75 g/L dextrose) was inoculated with a single colony of a completely beta-oxidation blocked strain of *Candida tropicalis* (ATCC20962) and the culture was grown overnight at 30° C., with shaking at about 300 rpm. Cells were pelleted by centrifugation for 10 minutes at 4° C. and 1,050×g and the supernatant discarded. Cells were resuspended in 20 mL TB-low nitrogen (low-N) media (1.7 g/L yeast nitrogen base without ammonium sulfate, 3.0 g/L yeast extract, 1.0 g/L $K_2HPO_4$, 1.0 g/L $KH_2PO_4$) and transferred to a new sterile 250 mL glass baffled flask and incubated at 30° C., with shaking at about 250 rpm, utilizing the following feeding schedule: dextrose fed to 0.1% at 0, 1, 2, 3, 4, and 5 hours, dextrose fed to 5% at 30 hours, decane fed to 0.7% at 0, 5, 30, and 48 hours. Samples were removed for gas chromatographic (GC) analysis at 0, 4, 30, and 72 hours. The GC profile showed that the culture accumulated the C10 dicarboxylic acid (sebacic acid) with very little accumulation of the C10 monocarboxylic acid (capric acid), as shown in FIG. 9. After 72 hours of incubation the concentration of sebacic acid was 0.94 g/L and the capric acid concentration was 0.01 g/L. There was no significant accumulation of any other monoacid or diacid.

Figure 10:
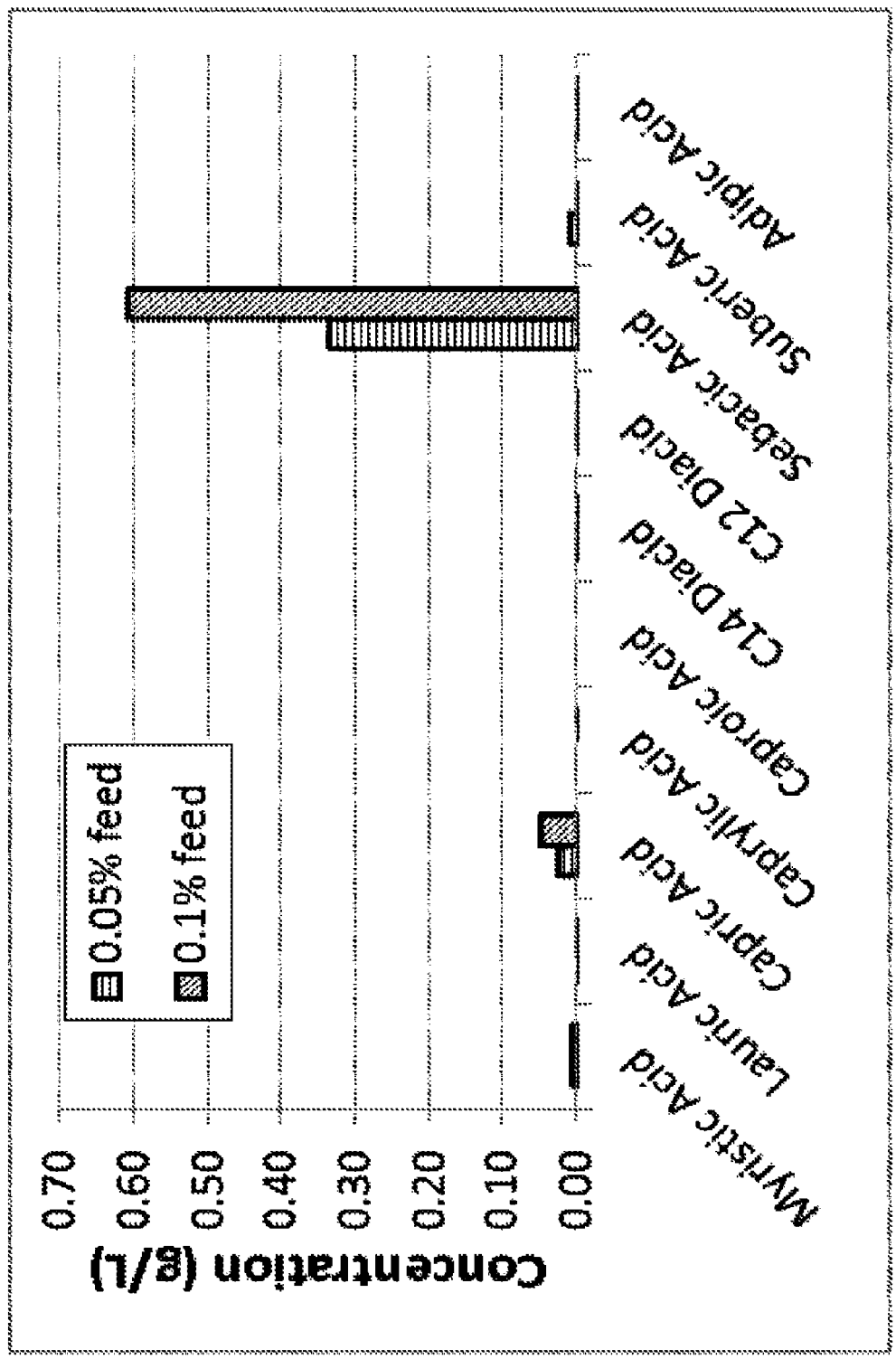
FIG. 10 graphically illustrates the conversion of capric acid to sebacic acid in a *C. tropicalis* yeast strain. GC analysis was performed after a predetermined period of growth. Nearly all the capric acid added was converted to sebacic acid using a starting concentration of capric acid. Experimental details and results are given in Example 2.

Example 2: Conversion of Capric Acid to Sebacic Acid in Shake Flask Fermentation 5 mL of SP92-glycerol medium (6.7 g/L yeast nitrogen base, 3.0 g/L yeast extract, 3.0 g/L (NH4)2SO4, 1.0 g/L K2HPO4, 1.0 g/L KH2PO4, 75 g/L glycerol) was inoculated with a single colony of *Candida tropicalis* (ATCC20962) and the starter culture was grown overnight at 30° C., with shaking at about 250 rpm. Variations of SP92 media recipes are known, non-limiting examples of which include the addition of dextrose and/or glycerol, the like or combinations thereof. SP92 media, as referred to herein, can include dextrose and/or glycerol. The starter culture was then used to inoculate 25 mL cultures in the same medium to an initial $OD_{600\ nm}$ of 0.4 and grown overnight at 30° C., with shaking at about 300 rpm. Cells were pelleted by centrifugation for 10 minutes at 4° C. and 1,050×g and the supernatant discarded. Cells were resuspended in 12.5 mL TB-lowN media+glycerol (1.7 g/L yeast nitrogen base without ammonium sulfate, 3.0 g/L yeast extract, 1.0 g/L K2HPO4, 1.0 g/L KH2PO4, 75 g/L glycerol) and transferred to a new sterile 250 mL glass baffled flask. Cultures were fed 0.05% or 0.1% capric acid and incubated at 30° C., with shaking at about 300 rpm. After 24 hours incubation cultures were fed glycerol to 75 g/L and incubation continued before sampling for GC at 48 hours. GC analysis showed that nearly all capric acid was converted to sebacic acid under both starting concentrations of capric acid, as shown in FIG. 10.

Example 3: Fermentation Procedure for Conversion of Decane to Sebacic Acid

Filter sterilized modified SP92-glycerol fermentation medium (6.7 g/L yeast nitrogen base, 3.0 g/L yeast extract, 3.0 g/L (NH4)2SO4, 1.0 g/L K2HPO4, 1.0 g/L KH2PO4, 20 g/L glycerol) is transferred to a sterile fermentation vessel. Growth of *Candida tropicalis* (ATCC20962) is inoculated to an initial $OD_{600\ nm}$ of about 1.0 with a 5% inoculum and growth carried out under the following conditions: 30° C. with shaking at about 1000 rpm, 1 volume per volume per minute aeration (vvm), pH 5.8 and initial volume of 0.3 L. Growth proceeds for approximately 8 hours and the conversion phase is initiated by the addition of decane to 2 g/L. Continuous feeds for decane (1 g/L-h) and glucose (1.5 g/L-h) are initiated at the same time as the addition of the decane bolus. Fermentation conditions are maintained at 30° C., 1000 rpm, 1 vvm, and pH 5.8 for 44 hours.

Samples were collected for GC analysis at 44 hours after initiating the conversion phase. The data, presented in FIG. 16, shows that the decane was converted exclusively to the C10 dicarboxylic acid, sebacic acid. Significant evaporative losses from the decane feed bottles prevented an accurate determination of product yield.

Example 4: Conversion of Mixed Fatty Acid Feedstock to Mixed Diacid Products Containing Sebacic Acid in Shake Flask Fermentation 5 mL of SP92-glycerol medium (6.7 g/L yeast nitrogen base, 3.0 g/L yeast extract, 3.0 g/L (NH4)2SO4, 1.0 g/L K2HPO4, 1.0 g/L KH2PO4, 75 g/L glycerol) is inoculated with a single colony of *Candida tropicalis* (ATCC20962) and grown as described in Example 2. 25 mL of the same media is inoculated using overnight cultures to an initial $OD_{600\ nm}$ of 0.4 and grown overnight at 30° C., with shaking at about 300 rpm. Cells are pelleted by centrifugation for 10 minutes at 4° C. and 1,050×g and the supernatant discarded. Cells are resuspended in 12.5 mL TB-lowN media without carbon source (1.7 g/L yeast nitrogen base without ammonium sulfate, 3.0 g/L yeast extract, 1.0 g/L K2HPO4, 1.0 g/L KH2PO4) and transferred to a new sterile 250 mL glass baffled flask. Cultures are fed 0.05% capric acid, 0.05% methyl laurate, and 30 g/L glycerol and incubated at 30° C., 300 rpm. After 24 hours of incubation cultures are sampled for GC analysis.

The results, presented in FIG. 17, show that the C12 and C10 fatty acids were converted to dicarboxylic acids of the same chain length (e.g., C12 and C10 dicarboxylic acids), with no evidence of chain shortening of the diacids (e.g., no significant levels of monocarboxylic acids were detected).

Example 5: Conversion of Long Chain Fatty Acids to Mixed Diacids

Figure 11:
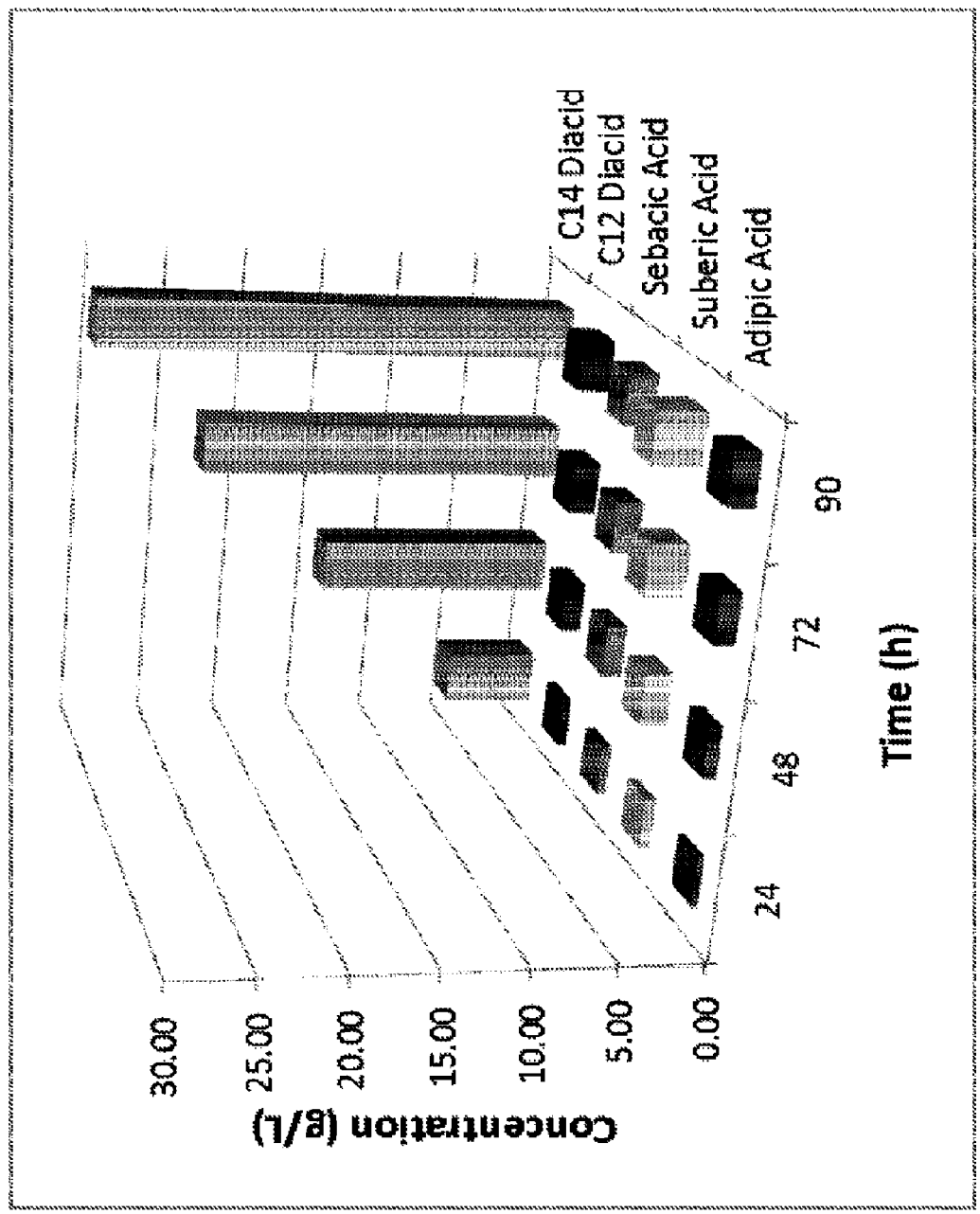
FIG. 11 graphically illustrates the distribution of diacids produced during the conversion of long-chain fatty acids to mixed diacids under fermentation conditions using a partially beta-oxidation blocked *Candida tropicalis* strain (e.g., sAA106). Experimental details and results are given in Example 5.

SP92 fermentation medium was filter sterilized and transferred to a sterile fermentation vessel. Growth of a partially beta-oxidation blocked strain of *Candida tropicalis* (sAA106) was initiated with a 10% inoculum (initial $OD_{600\ nm}=3.0$) and grown under the following conditions: of 30° C. with shaking at about 1200 rpm, 1 vvm, pH 6.1 and initial volume of 0.3 L. Growth continued until the glucose concentration dropped to less than 2 g/L at which time the conversion phase was initiated by increasing the pH to 8.0 by the addition of 6N KOH and by the addition of methyl myristate to 30 g/L. Immediately following the methyl myristate bolus a continuous feed of glucose was initiated at a rate of 1.5 g/L-h. Fermentation conditions were maintained at 30° C., 1200 rpm, 1 vvm, and pH 8.0 for 90 hours with boluses of 30 g/L methyl myristate at 24, 48, and 72 hours after initiation of conversion. Samples for GC were collected at 24, 48, 72, and 90 hours. The diacid profile graphically illustrated in FIG. 11 shows an accumulation of dicarboxylic acids ranging in chain-length from 6 to 14 carbons long, including sebacic acid. The methyl myristate substrate (methyl ester of myristic acid) is first converted to the C14 dicarboxylic acid via the □-oxidation pathway before being shortened by two carbon increments via the cyclic β-oxidation pathway. The glucose co-feed employed during the fermentation represses the β-oxidation pathway such that all chain-lengths of diacid accumulate. Manipulation of diacid chain-length distribution is being investigated by altering the glucose co-feed rate in the fermentation medium, thereby allowing growth under varying glucose concentrations.

Example 6: Fermentation Procedure for Conversion of Mixed Long-Chain Fatty Acids to Mixed Diacids of Shorter Chain Length SP92 fermentation medium without glycerol was filter sterilized and transferred to a sterile fermentation vessel.

Autoclaved virgin coconut oil was added to the vessel to a final concentration of 80 g/L. A partially beta-oxidation blocked *Candida tropicalis* strain (sAA496) was inoculated to an initial $OD_{600\,nm}$ of 1.0 with a 5% inoculum and grown under the following conditions: 30° C. with shaking at about 1200 rpm, 1 vvm, initial pH 6.5 and initial volume of 1.0 L. The effect of pH on the distribution of fatty acid chain lengths was determined by manipulating the pH of the fermentation media. The pH of the fermentation was either 1) increased to pH 7.5 and controlled at that pH for the entire run, 2) allowed to drop naturally due to the growth of the culture before controlling at pH 6.0 for the rest of the run, or 3) allowed to drop naturally due to the growth of the culture before controlling at pH 4.5 for the rest of the run. Samples were collected for GC analysis after 140 hours of fermentation time. The product diacid composition was shown to shift to longer chain diacids with increasing pH, as shown in the TABLE 1 below.

TABLE 1

| | Diacid composition (fraction of total diacids) | | | |
|---|---|---|---|---|
| | C12 Diacid | Sebacic Acid | Suberic Acid | Adipic Acid |
| pH 4.5 | 0.00 | 0.00 | 0.68 | 0.32 |
| pH 6.0 | 0.03 | 0.10 | 0.75 | 0.12 |
| pH 7.5 | 0.16 | 0.17 | 0.62 | 0.05 |

Figure 12:
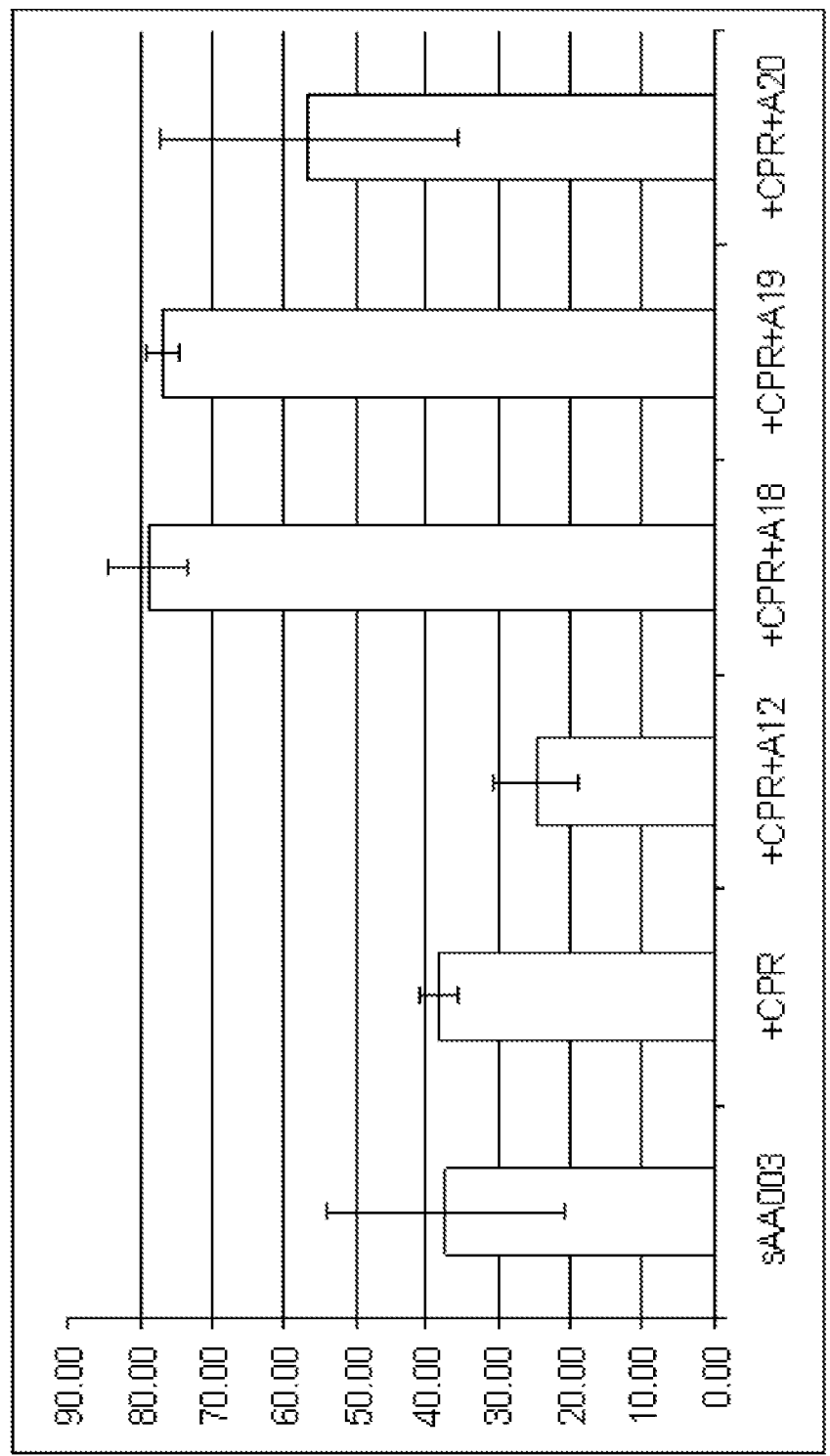

Example 7: Conversion of Capric Acid to Sebacic Acid in Shake Flask Fermentations Using Fully Beta-Oxidation Blocked Strains Having Additional Genetic Modifications in the Omega Oxidation Pathway Various genetically modified strains of *Candida tropicalis* were inoculated into 5 mL of SP92 medium (6.7 g/L yeast nitrogen base, 3.0 g/L yeast extract, 3.0 g/L $(NH_4)_2SO_4$, 1.0 g/L $K_2HPO_4$, 1.0 g/L $KH_2PO_4$, 75 g/L glycerol). The strains included a completely beta-oxidation blocked strain of *Candida tropicalis* (sAA003), as well as derivatives of sAA003 with amplified components of the omega-oxidation pathway (e.g., various cytochrome P450s, cytochrome P450 reductase or combinations thereof) and the cultures grown overnight at 30° C., with shaking at about 250 rpm. These starter cultures were then used to inoculate 25 mL cultures in the same medium and grown overnight at 30° C., with shaking at about 250 rpm. Cells were pelleted by centrifugation for 10 minutes at 4° C. and 1,050×g and the supernatant discarded. Cells were resuspended in 12.5 mL TB-lowN media+glycerol (1.7 g/L yeast nitrogen base without ammonium sulfate, 3.0 g/L yeast extract, 1.0 g/L $K_2HPO_4$, 1.0 g/L $KH_2PO_4$, 75 g/L glycerol) and transferred to a new sterile 250 mL glass baffled flask. Cultures were fed 0.05% from a 5% capric acid solution in ethanol and incubated at 30° C., with shaking at about 300 rpm. After 24 hours incubation cultures were fed glycerol to 30 g/L and an additional bolus of 0.05% capric acid. Incubation continued before sampling for GC at 24, 48, and 72 hours. The results are shown in FIG. 12. GC analysis showed that a greater proportion of capric acid was converted to sebacic acid when particular elements of the omega-oxidation pathway are amplified. The data are presented as % of theoretical maximum yield. Strains which include genetic modifications to CYPA18 and CYPA19 achieve approximately 80% of theoretical maximum yield in conversion of capric acid to sebacic acid. The strain designated +CPR+A18 has about 30 copies of CYPA18, whereas the strain designated +CPR+A19 has about 7 copies of CYPA19.

Example 8: Conversion of Methyl-Laurate to Dodecanedioic Acid in Shake Flask Fermentation 5 mL of SP92 glycerol medium (6.7 g/L yeast nitrogen base, 3.0 g/L yeast extract, 3.0 g/L (NH4)2SO4, 1.0 g/L K2HPO4, 1.0 g/L KH2PO4, 75 g/L glycerol) was inoculated with a single colony of a completely beta-oxidation blocked strain of *Candida tropicalis* (ATCC20962), as well as, modified derivatives of this strain with amplified components of the omega-oxidation pathway, and the cultures grown overnight at 30° C., with shaking at about 250 rpm. The starter cultures were then used to inoculate 25 mL cultures of the same medium and grown overnight at 30° C., with shaking at about 250 rpm. Cells were pelleted by centrifugation for 10 minutes at 4° C. and 1,050×g and the supernatant discarded. Cells were resuspended in 12.5 mL SP92 glycerol medium and transferred to a sterile 250 mL glass baffled flask. Cultures were fed 2% (v/v) methyl laurate and incubated at 30° C., with shaking at about 300 rpm. After 24 hours incubation, cultures were fed glycerol to 60 g/L and incubation continued before sampling for GC at 48 hours. GC analysis showed that amplification of certain components of the omega oxidation pathway allow for increased conversion to dodecanedioic acid (FIG. 13).

Example 9: Alteration of Acyl CoA Oxidase Substrate Specificity

The substrate specificity of the peroxisomal acyl-CoA oxidase enzymes POX4 and POX5 have been shown to be involved in the control of the diacid product chain-length in fermentations of *Candida tropicalis* fed a mixed chain-length fatty acid feedstock. Reduction or elimination of POX4 activity, POX5 activity or POX4 activity and POX5 activity, effects the carbon chain-length distribution of dicarboxylic acids produced in *C. tropicalis*. Acyl-CoA oxidase is the first enzyme in the cyclic beta-oxidation pathway that shortens a substrate by two carbons each cycle. Thus the acyl-CoA oxidase activity serves as the pathway entry point for substrates entering into the beta-oxidation pathway. Altering the substrate specificity an acyl-CoA oxidase activity such that it is not active on substrate carbon chains shorter than a desired carbon chain length (e.g., C8, C10, C12, C14 and the like), can inhibit shortening of carbon chains below a chosen threshold, allowing accumulation of a desired target chain length and product (e.g., C12, dodecanedioic acid).

The native acyl-CoA oxidase isozymes in *C. tropicalis*, Pox4p and Pox5p have different substrate specificities. The Pox4p isozyme has a broad substrate specificity while the Pox5p isozyme has a narrow substrate specificity. In strains that are Pox4$^-$, Pox5$^+$ the chain length of the diacid product is determined by the substrate specificity of the Pox5p isozyme and the main product is adipic acid.

To maximize production of desired diacid products of longer chain lengths (e.g., C12) in fermentations, genetically modified organisms containing an acyl-CoA oxidase activity with a substrate chain-length specificity appropriate for the chain-length of the desired diacid product can be engineered, in some embodiments. The source of the acyl-CoA oxidase activity or the method of engineering the acyl-CoA oxidase activity may vary. Non-limiting examples of organisms which can be used to provide polynucleotide sequences suitable for use in engineering altered substrate specificity acyl-CoA oxidase activities include; plants (e.g., *Arabidopsis, Cucurbita* (e.g., pumpkin, squash), *Oryza* (e.g., rice)); animals (e.g., *Bos* (e.g., bovine), *Cavia* (e.g., guinea pig), *Mus* (e.g., mouse), *Rattus* (e.g., rat), *Phascolarctos* (e.g., Koala), primates (e.g., orangutans)); molds (e.g., *Dictyostelium* (e.g., slime molds)); insects (e.g., *Drosophila*); Yeast (e.g., *Yarrowia lipolytica, Candida maltosa, Candida glabrata, Ashbya gossypii, Debaryomyces hansenii, Kluyveromyces lactis, Pichia pastoris, Saccharomyces cerevisiae*); bacteria (e.g., *Eschericia coli*); cyanobacteria; nematodes (e.g., *Caenorhabditis*); and humans.

Acyl-CoA oxidase activities with different substrate chain-length specificities can be identified by:

1) Selecting acyl-CoA oxidase genes from heterologous organisms that contain different substrate chain-length specificities. The identified genes can be transferred into a *Candida* strain deleted for all acyl-CoA oxidase activity. The only acyl-CoA oxidase activity detectable in such a genetically modified organism may be that imparted by the heterologous gene.

2) Engineering an acyl-CoA oxidase gene library by domain swapping from multiple acyl-CoA oxidase genes to produce a library of non-native chimeric acyl-CoA oxidase genes. The library of chimeric genes can be transferred into a strain of *C. tropicalis* deleted for all acyl-CoA oxidase activity. The only detectable acyl-CoA oxidase activity may be that imparted by an engineered gene from the library of non-native chimeric acyl-CoA oxidase genes.

3) Engineering an acyl-CoA oxidase gene library by random mutagenesis. A naturally occurring or engineered acyl-CoA oxidase activity with a substrate chain-length specificity close to that desired can be used as the basis for random mutagenesis, followed by screening and/or selection in an effort to generate and identify an altered activity with the desired substrate chain-length specificity. The library of genes can be transferred into a *Candida* strain deleted for all acyl-CoA oxidase activity. The only detectable acyl-CoA oxidase activity may be that imparted by the gene from the randomly mutagenized library.

4) Engineering an acyl-CoA oxidase gene by intelligent design and directed mutation using protein structural information to guide the position and identity of the amino acid(s) to be replaced. The engineered gene(s) can be transferred into a *Candida* strain deleted for all acyl-CoA oxidase activity. The only detectable acyl-CoA oxidase activity may be that imparted by the engineered gene(s).

A non-limiting example of a post-engineering method for selecting genes that impart the desired substrate chain-length specificity is provided herein. Selection is performed by growth on substrates of different chain lengths that are provided as the only carbon source. Growth of the cells on certain substrates but not others often reflects the substrate chain-length specificity of the acyl-CoA oxidase enzyme present in the strain. *Candida tropicalis* can utilize alkanes provided in the gas phase as its sole carbon source for growth. Alkanes of different chain lengths are provided by soaking a filter paper in the appropriate alkane, and inverting a solid growth media without a carbon source over the filter paper, with each specific carbon source (e.g., specific chain length alkane) provided in a different petri dish. Serially diluted *C. tropicalis* carrying the altered specificity acyl-CoA oxidase genes are spotted on the solid growth media as a growth selection for the chain-length specificity of the acyl-CoA oxidase enzyme in each strain. Shown in FIGS. 14 and 15 are a schematic representation of the selection process, which provides an alkane as a gas phase carbon source, as described herein. The solid growth media is an agar medium containing yeast nitrogen base without amino acids or any other carbon source. The plated cells are inverted over a lid containing a filter paper soaked with an alkane of appropriate chain length that evaporates and provides the carbon source through the gas phase, as shown in FIG. 14.

*Candida* strains containing altered acyl-CoA oxidase activities generated as described herein are selected and/or screened using the method described herein. Strains carrying different altered acyl-CoA oxidase activities (e.g., strain 1 (S1), strain 2 (S2), strain 3 (S3), strain 4 (S4)) are grown overnight in a rich medium (e.g., YPD). Overnight cultures are centrifuged and washed to remove any traces of residual rich medium and serial dilutions of the cells are prepared in a phosphate buffered solution. The serial dilutions of each strain are spotted onto multiple YNB agar plates (growth medium having no amino acids or other carbon sources), the individual plates inverted over filter papers soaked in the appropriate chain length alkane, and the plate incubated at 30° C. The growth of the strains is dependent upon the chain-length specificity of the acyl-CoA oxidase. In order to utilize the particular alkane for growth the provided chain-length must be able to enter the beta-oxidation pathway. The shortest chain-length at which a certain strain is able to grow indicates the shortest chain-length of the acyl-CoA oxidase isozymes substrate specificity. An example is provided in FIG. 15. FIG. 15 illustrates that strain S4 can grow on decane, but is unable to grow on octane. Therefore the modified acyl-CoA oxidase activity of strain S4 has a substrate chain-length specificity that inhibits the utilization of 8 carbon molecules and the diacid product from fermentations with this strain typically result in an 8 carbon diacid. Acyl-CoA oxidase activities with any desired specificity can be selected and/or screened using the method described herein.

It will be understood that the example presented herein is a generalized method used to describe the selection/screening process. The feedstocks used for the selection and screening process are altered to suit the acyl-CoA oxidase activity being sought. For example, for acyl-CoA oxidases having specificity for longer chain substrates, feedstocks having longer carbon chain lengths could be substituted to allow selection and or screening for acyl-CoA oxidase activities with specificities for longer carbon chain lengths.

Example 10: Transformation of *C. tropicalis* Procedure 5 mL YPD start cultures were inoculated with a single colony of *C. tropicalis* and incubated overnight at 30° C., with shaking at about 200 rpm. The following day, fresh 25 mL YPD cultures, containing 0.05% Antifoam B, were inoculated to an initial $OD_{600\ nm}$ of 0.4 and the culture incubated at 30° C., with shaking at about 200 rpm until an $OD_{600\ nm}$ of 1.0-2.0 was reached. Cells were pelleted by centrifugation at 1,000×g, 4° C. for 10 minutes. Cells were washed by resuspending in 10 mL sterile water, pelleted, resuspended in 1 mL sterile water and transferred to a 1.5 mL microcentrifuge tube. The cells were then washed in 1 mL sterile TE/LiOAC solution, pH 7.5, pelleted, resuspended in 0.25 mL TE/LiOAC solution and incubated with shaking at 30° C. for 30 minutes.

The cell solution was divided into 50 uL aliquots in 1.5 mL tubes to which was added 5-8 ug of linearized DNA and 5 uL of carrier DNA (boiled and cooled salmon sperm DNA, 10 mg/mL). 300 uL of sterile PEG solution (40% PEG 3500, 1×TE, 1×LiOAC) was added, mixed thoroughly and incubated at 30° C. for 60 minutes with gentle mixing every 15 minutes. 40 uL of DMSO was added, mixed thoroughly and the cell solution was incubated at 42° C. for 15 minutes. Cells were then pelleted by centrifugation at 1,000×g 30 seconds, resuspended in 500 uL of YPD media and incubated at 30° C. with shaking at about 200 rpm for 2 hours. Cells were then pelleted by centrifugation and resuspended in 1 mL 1×TE, cells were pelleted again, resuspended in 0.2 mL 1×TE and plated on selective media. Plates were incubated at 30° C. for growth of transformants.

Example 11: Procedure for Recycling of the URA3 Marker

The URA3 gene was obtained from genomic DNA of Candida yeast culture ATCC20336. C. tropicalis has a limited number of selectable marker, as compared to S. cerevisiae, therefore, the URA3 marker is "recycled" to allow multiple rounds of selection using URA3. To reutilize the URA3 marker for subsequent engineering of C. tropicalis, a single colony having the Ura$^+$ phenotype was inoculated into 3 mL YPD and grown overnight at 30° C. with shaking. The overnight culture was then harvested by centrifugation and resuspended in 1 mL YNB+YE (6.7 g/L Yeast Nitrogen Broth, 3 g/L Yeast Extract). The resuspended cells were then serially diluted in YNB+YE and 100 uL aliquots plated on YPD plates (incubation overnight at 30° C.) to determine titer of the original suspension. Additionally, triplicate 100 uL aliquots of the undiluted suspension were plated on SC Dextrose (Bacto Agar 20 g/L, Uracil 0.3 g/L, Dextrose 20 g/L, Yeast Nitrogen Broth 6.7 g/L, Amino Acid Dropout Mix 2.14 g/L) and 5-FOA. at 3 different concentrations (0.5, 0.75, 1 mg/mL).

Plates were incubated for at least 5 days at 30° C. Colonies arising on the SC Dextrose+5-FOA plates were resuspended in 50 uL sterile, distilled water and 5 uL utilized to streak on to YPD and SC-URA (SC Dextrose medium without Uracil) plates. Colonies growing only on YPD and not on SC-URA plates were then inoculated into 3 mL YPD and grown overnight at 30° C. with shaking. Overnight cultures were harvested by centrifugation and resuspended in 1.5 mL YNB (6.7 g/L Yeast Nitrogen Broth). The resuspended cells were serially diluted in YNB and 100 uL aliquots plated on YPD plates and incubation overnight at 30° C. to determine initial titer. 1 mL of each undiluted cell suspension also was plated on SC-URA and incubated for up to 7 days at 30° C. Colonies on the SC-URA plates are revertants and the isolate with the lowest reversion frequency (<10$^{-7}$) was used for subsequent strain engineering.

Example 12: Cloning and Analysis of C. tropicalis Fatty Alcohol Oxidase (FAO) Alleles Isolation of Fatty Alcohol Oxidase Genes from C. tropicalis C. tropicalis (ATCC20336) fatty alcohol oxidase genes were isolated by PCR amplification using primers generated to amplify the sequence region covering promoter, fatty alcohol oxidase gene (FAO) and terminator of the FAO1 sequence (GenBank accession number of FAO1 AY538780). The primers used to amplify the fatty alcohol oxidase nucleotide sequences from Candida strain ATCC20336, are showing in the TABLE 2 below.

TABLE 2

Oligonucleotides for cloning FAO alleles

| Oligo | Sequence (SEQ ID NOS 218-226, respectively, in order of appearance) |
|---|---|
| oAA0144 | AACGACAAGATTAGATTGGTTGAGA |
| oAA0145 | GTCGAGTTTGAAGTGTGTGTCTAAG |
| oAA0268 | AGATCTCATATGGCTCCATTTTTGCCCGACCAGGTCGAC TACAAACACGTC |
| oAA0269 | ATCTGGATCCTCATTACTACAACTTGGCTTTGGTCTTCA AGGAGTCTGCCAAACCTAAC |
| oAA0282 | ACATCTGGATCCTCATTACTACAACTTGGCCTTGGTCT |
| oAA0421 | CACACAGCTCTTCTAGAATGGCTCCATTTTTGCCCGACC AGGTCGAC |
| oAA0422 | CACACAGCTCTTCCTTTCTACAACTTGGCTTTGGTCTTC AAGGAGTCTGC |
| oAA0429 | GTCTACTGATTCCCCTTTGTC |
| oAA0281 | TTCTCGTTGTACCCGTCGCA |

PCR reactions contained 25 uL 2× master mix, 1.5 uL of oAA0144 and oAA0145 (10 uM), 3.0 uL genomic DNA, and 19 uL sterile H$_2$O. Thermocycling parameters used were 98° C. for 2 minutes, 35 cycles of 98° C. 20 seconds, 52° C. 20 seconds, 72° C. 1 minute, followed by 72° C. 5 minutes and a 4° C. hold. PCR products of the correct size were gel purified, ligated into pCR-Blunt II-TOPO (Invitrogen) and transformed into competent TOP10 E. coli cells (Invitrogen). Clones containing PCR inserts were sequenced to confirm correct DNA sequence. Four FAO alleles were identified from sequence analysis and designated as FAO-13, FAO-17, FAO-18 and FAO-20. The sequence of the clone designated FAO-18 had a sequence that was substantially identical to the sequence of FAO1 from GenBank. The resulting plasmids of the four alleles were designated pAA083, pAA084, pAA059 and pAA085, respectively. Sequence identity comparisons of FAO genes isolated as described herein are shown in the TABLE 3-5 below.

TABLE 3

DNA sequence identity

|  | FAO1 | FAO-18 | FAO-17 | FAO-13 | FAO-20 | FAO2a | FAO2b |
|---|---|---|---|---|---|---|---|
| FAO1 | 100 | 100 | 98 | 96 | 95 | 83 | 82 |
| FAO-18 |  | 100 | 98 | 96 | 95 | 83 | 82 |
| FAO-17 |  |  | 100 | 98 | 98 | 83 | 82 |
| FAO-13 |  |  |  | 100 | 99 | 83 | 83 |
| FAO-20 |  |  |  |  | 100 | 83 | 83 |
| FAO2a |  |  |  |  |  | 100 | 96 |
| FAO2b |  |  |  |  |  |  | 100 |

TABLE 4

Protein sequence identity

|  | FAO1 | FAO-18 | FAO-17 | FAO-13 | FAO-20 | FAO2a | FAO2b |
|---|---|---|---|---|---|---|---|
| FAO1 | 100 | 100 | 99 | 98 | 98 | 81 | 80 |
| FAO-18 |  | 100 | 99 | 98 | 98 | 81 | 80 |
| FAO-17 |  |  | 100 | 99 | 99 | 82 | 81 |
| FAO-13 |  |  |  | 100 | 99 | 82 | 81 |

TABLE 4-continued

Protein sequence identity

|  | FAO1 | FAO-18 | FAO-17 | FAO-13 | FAO-20 | FAO2a | FAO2b |
|---|---|---|---|---|---|---|---|
| FAO-20 |  |  |  |  | 100 | 82 | 81 |
| FAO2a |  |  |  |  |  | 100 | 97 |
| FAO2b |  |  |  |  |  |  | 100 |

TABLE 5

Amino acid differences in FAO alleles

|  | 32 | 75 | 89 | 179 | 185 | 213 | 226 | 352 | 544 | 590 |
|---|---|---|---|---|---|---|---|---|---|---|
| FAO1 | E | M | G | L | Y | T | R | H | S | P |
| FAO-13 | Q | T | A | L | Y | A | K | Q | A | A |
| FAO-20 | Q | T | A | M | D | A | K | Q | A | A |

Expression of FAO Alleles in *E. coli*

To determine the levels of FAO enzyme activity with respect to various carbon sources, the four isolated FAO alleles were further cloned and over-expressed in *E. coli*. The FAOs were amplified using the plasmids mentioned above as DNA template by PCR with primers oAA0268 and oAA0269 for FAO-13 and FAO-20 and oAA0268 and oAA0282 for FAO-17 and FAO-18, using conditions as described herein. PCR products of the correct size were gel purified and ligated into pET11a vector between NdeI and BamHI sites and transformed into BL21 (DE3) *E. coli* cells. The colonies containing corresponding FAOs were confirmed by DNA sequencing. Unmodified pET11a vector also was transformed into BL21 (DE3) cells, as a control. The resulting strains and plasmids were designated sAA153 (pET11a), sAA154 (pAA079 containing FAO-13), sAA155 (pAA080 containing FAO-17), sAA156 (pAA081 containing FAO-18) and sAA157 (pAA082 containing FAO-20), respectively. The strains and plasmids were used for FAO over-expression in *E. coli*. One colony of each strain was transferred into 5 mL of LB medium containing 100 □g/mL ampicillin and grown overnight at 37° C., 200 rpm. The overnight culture was used to inoculate a new culture to $OD_{600\ nm}$ 0.2 in 25 ml LB containing 100 □g/ml ampicillin. Cells were induced at $OD_{600\ nm}$ 0.8 with 0.3 mM IPTG for 3 hours and harvested by centrifugation at 4° C. 1,050×g for 10 minutes. The cell pellet was stored at −20° C.

Expression of FAOs in *C. tropicalis*

Two alleles, FAO-13 and FAO-20, were chosen for amplification in *C. tropicalis* based on their substrate specificity profile, as determined from enzyme assays of soluble cell extracts of *E. coli* with over expressed FAOs. DNA fragments containing FAO-13 and FAO-20 were amplified using plasmids pAA079 and pAA082 as DNA templates, respectively, by PCR with primers oAA0421 and oAA0422. PCR products of the correct sizes were gel purified and ligated into pCR-Blunt II-TOPO (Invitrogen), transformed into competent TOP10 *E. coli* cells (Invitrogen) and clones containing FAO inserts were sequenced to confirm correct DNA sequence. Plasmids containing FAO-13 and FAO-20 were digested with SapI and ligated into vector pAA105, which includes the *C. tropicalis* PGK promoter and terminator. The resulting plasmids were confirmed by restriction digestion and DNA sequencing and designated as pAA115 (FAO-13) and pAA116 (FAO-20), respectively. Plasmids pAA115 and pAA116 were linearized with SpeI, transformed into competent *C. tropicalis* Ura⁻ strains sAA002 (SU-2, ATCC20913) and sAA103. The integration of FAO-13 and FAO-20 was confirmed by colony PCR using primers oAA0429 and oAA0281. The resulting strains were designated as sAA278 (pAA115 integrated in strain sAA002), sAA280 (pAA116 integrated in sAA002), sAA282 (pAA115 integrated in sAA103), and sAA284 (pAA116 integrated in sAA103), and were used for fatty alcohol oxidase over-expression in *C. tropicalis*.

One colony of each strain was inoculated into 5 ml YPD and grown overnight as described herein. The overnight culture was used to inoculate a new 25 mL YPD culture to about $OD_{600\ nm}$ 0.5. FAO over-expression was regulated by the PGK promoter/terminator, induced with glucose in the medium and expressed constitutively. Strains sAA002 and sAA103 (e.g., untransformed starting strains) were included as negative controls for FAO over-expression. Cells were harvested at early log phase ($OD_{600\ nm}$=in the range of between about 3 to about 5) by centrifugation at 4° C. for 10 minutes at 1,050×g. Cell pellets were stored at −20° C.

Cell Extract Preparation from *E. coli*

Cell pellets from 25 mL of FAO expressing *E. coli* cultures were resuspended in 10 mL phosphate-glycerol buffer containing 50 mM potassium phosphate buffer (pH7.6), 20% glycerol, 1 mM Phenylmethylsulfonyl fluoride (PMSF), 2 uL Benzonase 25 U/uL, 20 uL 10 mg/mL lysozyme. The cells were then lysed by incubation at room temperature for 50 minutes on a rotating shaker, and the cell suspension centrifuged for 30 minutes at 4° C. using 15,000×g for. The supernatant was aliquoted in 1.5 ml microcentrifuge tubes and stored at −20° C. for FAO enzyme activity assays.

Cell Extract Preparation from *C. tropicalis*

Frozen *C. tropicalis* cell pellets were resuspended in 1.2 ml of phosphate-glycerol buffer containing 50 mM potassium phosphate buffer (pH7.6), 20% glycerol, 1 mM Phenylmethylsulfonyl fluoride (PMSF). Resuspended cells were transferred to 1.5 mL screw-cap tubes containing about 500 uL of zirconia beads on ice. The cells were lysed with a Bead Beater (Biospec) using 2 minute pulses and 1 minute rest intervals on ice. The process was repeated 3 times. The whole cell extract was then transferred to a new 1.5 ml tube and centrifuged at 16,000×g for 15 minutes at 4° C. The supernatant was transferred into a new tube and used for FAO enzyme activity assays.

Protein Concentration Determination

Protein concentration of the cell extracts was determined using the Bradford Reagent following manufacturers' recommendations (Cat#23238, Thermo Scientific).

FAO Enzyme Activity Assay

FAO enzyme activity assays were performed using a modification of Eirich et al., 2004). The assay utilizes a two-enzyme coupled reaction (e.g., FAO and horse radish peroxidase (HRP)) and can be monitored by spectrophotometry. 1-Dodecanol was used as a standard substrate for fatty alcohol oxidase enzymatic activity assays. FAO oxidizes the dodecanol to dodecanal while reducing molecular oxygen to hydrogen peroxide simultaneously. HRP reduces (2,2'-azino-bis 3-ethylbenzthiazoline-6-sulfonic acid; ABTS) in the two-enzyme coupled reaction, where the electron obtained from oxidizing hydrogen peroxide to ABTS, which can be measured by spectrometry at 405 nm. The assay was modified using aminotriazole (AT) to prevent the destruction of $H_2O_2$ by endogenous catalase, thus eliminating the need for microsomal fractionation. The final reaction mixture (1.0 mL) for FAO enzyme assay consisted of 500 uL of 200 mM HEPES buffer, pH 7.6; 50 uL of a 10 mg/mL ABTS solution in deionized water; 10 uL of 5 mM solution of dodecanol in acetone; 40 uL of 1M AT and 5 uL of a 2 mg/mL horseradish peroxidase solution in 50 mM potassium phosphate buffer, pH 7.6. Reaction activity was measured by measuring light absorbance at 405 nm for 10 minutes at room temperature after adding the extract. The amount of extract added to the reaction mixture was varied so that the activity fell within the range of 0.2 to 1.0 $\Delta A_{405\ nm}$/min. The actual amounts of extract used were about 1.69 U/mg for E. coli expressed FAO-13, 0.018 U/mg for E. coli expressed FAO-17, 0.35 U/mg for E. coli expressed FAO-18 (e.g., FAO1), 0.47 U/mg E. coli expressed FAO-20, 0.036 U/mg C. tropicalis (strain sAA278) expressed FAO-13, 0.016 U/mg C. tropicalis (strain sAA282) expressed FAO-13, 0.032 U/mg C. tropicalis (strain sAA280) expressed FAO-20 and 0.029 U/mg C. tropicalis (strain sAA284) expressed FAO-20. FAO activity was reported as activity units/mg of total protein (1 unit=1 □mole substrate oxidized/min). An extinction coefficient at 405 nm of 18.4 was used for ABTS and was equivalent to 0.5 mM oxidized substrate. The results of the activity assays are shown in TABLES 6-7 below.

ATCC20336 as well as modifications to allow insertion of C. tropicalis promoters and terminators. A 1,507 bp DNA fragment containing the promoter, ORF, and terminator of URA3 from C. tropicalis ATCC20336 was amplified using primers oAA0124 and oAA0125, shown in the TABLE 8 below. The URA3 PCR product was digested with NdeI/MluI and ligated into the 2,505 bp fragment of pUC19 digested with NdeI/BsmBI (an MluI compatible overhang was produced by BsmBI). In order to replace the lac promoter with a short 21 bp linker sequence, the resulting plasmid was digested with SphI/SapI and filled in with a linker produced by annealing oligos oAA0173 and oAA0174. The resulting plasmid was designated pAA061.

TABLE 8

Oligonucleotides for construction of pAA061

| Oligos | Sequence (SEQ ID NOS 227-230, respectively, in order of appearance) | PCR product (bp) |
| --- | --- | --- |
| oAA0124 | cacacacatatgCGACGGGTACAACGAGAATT | 1507 |
| oAA0125 | cacacaacgcgtAGACGAAGCCGTTCTTCAAG | |
| oAA0173 | ATGATCTGCCATGCCGAACTC | 21 |
| oAA0174 | AGCGAGTTCGGCATGGCAGATCATCATG | (linker) |

TABLE 6

FAO activity (units/mg total protein) on primary alcohols

| | 1-Butanol | 1-Pentanol | 1-Hexanol | 1-Octanol | 1-Decanol | 1-Dodecanol | 1-Tetradecanol | Hexadecanol |
| --- | --- | --- | --- | --- | --- | --- | --- | --- |
| FAO-13 | 0.01 | 0.09 | 1.17 | 82.67 | 70.94 | 100 | 79.35 | 58.88 |
| FAO-17 | 0.72 | 0.26 | 1.06 | 66.23 | 22.00 | 100 | 47.86 | 60.98 |
| FAO-18 | 0.07 | 0.11 | 0.26 | 60.56 | 54.56 | 100 | 114.47 | 50.65 |
| FAO-20 | 0.07 | 0.11 | 0.91 | 55.96 | 74.57 | 100 | 89.52 | 42.59 |

TABLE 7

FAO activity (units/mg total protein) on omega hydroxy fatty acids

| | 1-Dodecanol | 6-OH-HA | 10-OH-DA | 12-OH-DDA | 16-OH-HDA |
| --- | --- | --- | --- | --- | --- |
| FAO-13 | 100 | 4.18 | 4.14 | 6.87 | 8.57 |
| FAO-17 | 100 | 1.18 | 0.00 | 0.59 | 0.94 |
| FAO-18 | 100 | 0.00 | 0.00 | 4.87 | 2.94 |
| FAO-20 | 100 | 0.03 | 0.04 | 2.25 | 7.46 |

Example 13: Construction of C. tropicalis Shuttle Vector pAA061

Vector pAA061 was constructed from a pUC19 backbone to harbor the selectable marker URA3 from Candida strain Example 14: Cloning of C. tropicalis PGK Promoter and Terminator Vector pAA105 was constructed from base vector pAA061 to include the phosphoglycerate kinase (PGK) promoter and terminator regions from C. tropicalis ATCC20336 with an intervening multiple cloning site (MCS) for insertion of open reading frames (ORF's). The PGK promoter region was amplified by PCR using primers oAA0347 and oAA0348, shown in the TABLE 9 below. The 1,029 bp DNA fragment containing the PGK promoter was digested with restriction enzymes PstI/XmaI. The PGK terminator region was amplified by PCR using primers oAA0351 and oAA0352, also shown in the TABLE 9 below. The 396 bp DNA fragment containing the PGK terminator was digested with restriction enzymes XmaI/EcoRI. The 3,728 bp PstI/EcoRI DNA fragment from pAA061 was used in a three piece ligation reaction with the PGK promoter and terminator regions to produce pAA105. The sequence between the PGK promoter and terminator contains restriction sites for incorporating ORF's to be controlled by the functionally linked constitutive PGK promoter.

TABLE 9

Oligonucleotides for cloning C. tropicalis PGK promoter and terminator

| Oligos | Sequence (SEQ ID NOS 231-234, respectively, in order of appearance) | PCR product (bp) |
|---|---|---|
| oAA0347 | CACACACTGCAGTTGTCCAATGTAATAATTTT | 1028 |
| oAA0348 | CACACATCTAGACCCGGGCTCTTCTTCTGAATAGGCAATTGATAAACTTACTTATC | |
| oAA0351 | GAGCCCGGGTCTAGATGTGTGCTCTTCCAAAGTACGGTGTTGTTGACA | 396 |
| oAA0352 | CACACACATATGAATTCTGTACTGGTAGAGCTAAATT | |

Example 15: Cloning of the POX4 Locus

Primers oAA0138 and oAA0141 (TABLE 10) were generated to amplify the entire sequence of NCBI accession number M12160 for the YSAPOX4 locus from genomic DNA prepared from Candida strain ATCC20336. The 2,845 bp PCR product was cloned into the vector, pCR-BluntII-TOPO (Invitrogen), sequenced and designated pAA052.

TABLE 10

Oligonucleotides for cloning of PDX4

| Oligos | Sequence (SEQ ID NOS 235-236, respectively, in order of appearance) | PCR product (bp) |
|---|---|---|
| oAA0138 | GAGCTCCAATTGTAATATTTCGGG | 2845 |
| oAA0141 | GTCGACCTAAATTCGCAACTATCAA | |

Example 16: Cloning of the POX5 Locus

Primers oAA0179 and oAA0182 (TABLE 11) were generated to amplify the entire sequence of NCBI accession number M12161 for the YSAPOX5 locus from genomic DNA prepared from Candida strain ATCC20336. The 2,624 bp PCR product was cloned into the vector, pCR-BluntII-TOPO (Invitrogen), sequenced and designated pAA049.

TABLE 11

Oligonucleotides for cloning of POX5

| Oligos | Sequence (SEQ ID NOS 237-238, respectively, in order of appearance) | PCR product (bp) |
|---|---|---|
| oAA0179 | GAATTCACATGGCTAATTTGGCCTCGGTTCCACAACGCACTCAGCATTAAAAA | 2624 |
| oAA0182 | GAGCTCCCCTGCAAACAGGGAAACACTTGTCATCTGATTT | |

Example 17: Construction of Strains with Amplified CPR and CYP52 Genes

Strains having an increased number of copies of cytochrome P450 reductase (CPR) and/or for cytochrome P450 monooxygenase (CYP52) genes were constructed to determine how over expression of CPR and CYP52 affected diacid production.

Cloning and Integration of the CPR Gene.

A 3,019 bp DNA fragment encoding the CPR promoter, ORF, and terminator from C. tropicalis ATCC750 was amplified by PCR using primers oAA0171 and oAA0172 (TABLE 12) incorporating unique SapI and SphI sites. The amplified DNA fragment was cut with the indicated restriction enzymes and ligated into plasmid pAA061, (described in Example 13) to produce plasmid pAA067. Plasmid pAA067 was linearized with ClaI and transformed into C. tropicalis Ura⁻ strain sAA103 (ura3/ura3, pox4::ura3/pox4::ura3, pox5::ura3/pox5::ura3). Transformations were performed with plasmid pAA067 alone and in combination with plasmids harboring the CYP52A15 or CYP52A16 genes, described below.

Cloning and Integration of CYP52A15 Gene.

A 2,842 bp DNA fragment encoding the CYP52A15 promoter, ORF, and terminator from C. tropicalis ATCC20336 was amplified by PCR using primers oAA0175 and oAA0178 (TABLE 12) and cloned into pCR-BluntII-TOPO for DNA sequence verification. The cloned CYP52A15 DNA fragment was isolated by restriction digest with XbaI/BamHI (2,742 bp) and ligated into plasmid pAA061, (described in Example 13), to produce plasmid pAA077. Plasmid pAA077 was linearized with PmlI and transformed into C. tropicalis Ura⁻ strain sAA103 (ura3/ura3, pox4::ura3/pox4::ura3, pox5::ura3/pox5::ura3). pAA077 was cotransformed with plasmid pAA067 harboring the CPR gene.

Cloning and Integration of CYP52A16 Gene.

A 2,728 bp DNA fragment encoding the CYP52A16 promoter, ORF, and terminator from C. tropicalis ATCC20336 was amplified by PCR using primers oAA0177 and oAA0178 (TABLE 12) and cloned into pCR-BluntII-TOPO for DNA sequence verification. The cloned CYP52A16 DNA fragment was amplified with primers oAA0260 and oAA0261 (TABLE 12) which incorporated unique SacI/XbaI restriction sites. The amplified DNA fragment was digested with SacI and XbaI restriction enzymes and ligated into plasmid pAA061 to produce plasmid pAA078. Plasmid pAA078 was linearized with ClaI and transformed into C. tropicalis Ura⁻ strain sAA103 (ura3/ura3, pox4::ura3/pox4::ura3, pox5::ura3/pox5::ura3). pAA078 was cotransformed with plasmid pAA067 harboring the CPR gene.

TABLE 12

Oligonucleotides for cloning of CPR, CYP52A15 and CYP52A16

| Oligos | Sequence (SEQ ID NOS 464-471, respectively, in order of appearance) | PCR product (bp) |
|---|---|---|
| oAA0171 | cacctcgctcttccAGCTGTCATGTCTATTCAATGCTTCGA | 3019 |
| oAA0172 | cacacagcatgcTAATGTTTATATCGTTGACGGTGAAA | |
| oAA0175 | cacaaagcggaagagcAAATTTTGTATTCTCAGTAGGATTTCATC | 2842 |
| oAA0178 | cacacagcatgCAAACTTAAGGGTGTTGTAGATATCCC | |
| oAA0177 | cacacacccgggATCGACAGTCGATTACGTAATCCATATTATTT | 2772 |
| oAA0178 | cacacagcatgCAAACTTAAGGGTGTTGTAGATATCCC | |
| oAA0260 | cacacagagctcACAGTCGATTACGTAATCCAT | 2772 |
| oAA0261 | cacatctagaGCATGCAAACTTAAGGGTGTTGTA | |

Preparation of Genomic DNA.

Genomic DNA was prepared from transformants for PCR verification and for Southern blot analysis. Isolated colonies were inoculated into 3 mL YPD and grown overnight at 30° C. with shaking. Cells were pelleted by centrifugation. To each pellet, 200 uL Breaking Buffer (2% Triton X-100, 1% SDS, 100 mM NaCl, 10 mM Tris pH 8 and, 1 mM EDTA) was added, and the pellet resuspended and transferred to a fresh tube containing 200 uL 0.5 mm Zirconia/Silica Beads. 200 uL Phenol:Chloroform:Isoamyl Alcohol (25:24:1) was added to each tube, followed by vortexing for 1 minute. Sterile distilled water was added (200 uL) to each tube and the tubes were centrifuged at 13000 rpm for 10 minutes. The aqueous layer was ethanol precipitated and washed with 70% ethanol. The pellet was resuspended in 100-200 □110 mM Tris, after drying. Genomic DNA preparation for southern blot analysis was performed using the same procedure on 25 mL cultures for each colony tested.

Characterization of Strains with Amplified CPR and CYP52 Genes.

Verification of gene integration was performed by PCR using primers oAA0252 and oAA0256 (CPR), oAA0231 and oAA0281 (CYP52A15), and oAA242 and oAA0257 (CYP52A16). The primers used for verification are shown in the TABLE 13.

TABLE 13

Oligonucleotides for PCR verification of CPR, CYP52A15 and CYP52A16

| Oligos | Sequence (SEQ ID NOS 472-477, respectively, in order of appearance) | PCR product (bp) |
|---|---|---|
| oAA0252 | TTAATGCCTTCTCAAGACAA | 743 |
| oAA0256 | GGTTTTCCCAGTCACGACGT | |
| oAA0231 | CCTTGCTAATTTTCTTCTGTATAGC | 584 |
| oAA0281 | TTCTCGTTGTACCCGTCGCA | |

TABLE 13-continued

Oligonucleotides for PCR verification of CPR, CYP52A15 and CYP52A16

| Oligos | Sequence (SEQ ID NOS 472-477, respectively, in order of appearance) | PCR product (bp) |
|---|---|---|
| oAA0242 | CACACAACTTCAGAGTTGCC | 974 |
| oAA0257 | TCGCCACCTCTGACTTGAGC | |

Southern blot analysis was used to determine the copy number of the CPR, CYP52A15 and CYP52A16 genes. Biotinylated DNA probes were prepared with gene specific oligonucleotides using the NEBlot Phototope Kit from New England BioLabs (Catalog #N7550S) on PCR products generated from each gene target as specified in TABLE 14. Southern Hybridizations were performed using standard methods (e.g., Sambrook, J. and Russell, D. W. (2001) Molecular Cloning: A Laboratory Manual, (3ʳᵈ ed.), pp. 6.33-6.64. Cold Spring Harbor Laboratory Press). Detection of hybridized probe was performed using the Phototope-Star Detection Kit from New England BioLabs (Catalog #N7020S). Copy number was determined by densitometry of the resulting bands.

TABLE 14

Oligonucleotides for Probe Template PCR of CPR, CYP52A15 and CYP52A16

| Oligos | Sequence (SEQ ID NOS 478-483, respectively, in order of appearance) | Gene | Template | PCR product (bp) |
|---|---|---|---|---|
| oAA0250 | AATTGAACATCAGAAGAGGA | CPR | pAA067 | 1313 |
| oAA0254 | CCTGAAATTTCCAAATGGTGTCTAA | | | |
| oAA0227 | TTTTTTGTGCGCAAGTACAC | CYP52A15 | pAA077 | 905 |
| oAA0235 | CAACTTGACGTGAGAAACCT | | | |
| oAA0239 | AGATGCTCGTTTTACACCCT | CYP52A16 | pAA078 | 672 |
| oAA0247 | ACACAGCTTTGATGTTCTCT | | | |

Example 18: Addition and/or Amplification of Monooxygenase and Monooxygenase Reductase Activities Cytochrome P450's often catalyze a monooxygenase reaction, e.g., insertion of one atom of oxygen into an organic substrate (RH) while the other oxygen atom is reduced to water:

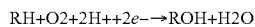

$$RH + O_2 + 2H^+ + 2e^- \rightarrow ROH + H_2O$$

The substrates sometimes are of a homogeneous carbon chain length. Enzymes with monooxygenase activity sometimes recognize substrates of specific carbon chain lengths, or a subgroup of carbon chain lengths with respect to organic substrates of homogenous carbon chain length. Addition of novel cytochrome activities (e.g., B. megaterium BM3) and/or amplification of certain or all endogenous or heterologous monooxygenase activities (e.g., CYP52A12 polynucleotide, CYP52A13 polynucleotide, CYP52A14 polynucleotide, CYP52A15 polynucleotide, CYP52A16 polynucleotide, CYP52A17 polynucleotide, CYP52A18 polynucleotide, CYP52A19 polynucleotide, CYP52A20 polynucleotide, CYP52D2 polynucleotide, BM3 polynucleotide) can contribute to an overall increase in carbon flux through native and/or engineered metabolic pathways, in some embodiments. In certain embodiments, adding a novel monooxygenase or increasing certain or all endogenous or heterologous monooxygenase activities can increase the flux of substrates of specific carbon chain length or subgroups of substrates with mixtures of specific carbon chain lengths. In some embodiments, the selection of a monooxygenase activity for amplification in an engineered strain is related to the feedstock utilized for growth of the engineered strain, pathways for metabolism of the chosen feedstock and the desire end product (e.g., dodecanedioic acid).

Strains engineered to utilize plant-based oils for conversion to dodecanedioic acid can benefit by having one or more monooxygenase activities with substrate specificity that matches the fatty acid chain-length distribution of the oil. For example, the most prevalent fatty acid in coconut oil is lauric acid (12 carbons long), therefore, the monooxygenase activity chosen for a coconut oil-utilizing strain can have a substrate preference for C12 fatty acids. For strains engineered to utilize other plant based oils with different fatty acid chain-length distributions it may be desirable to amplify a monooxygenase activity that has a matching substrate preference. In some embodiments, a genetic modification that alters monooxygenase activity increases the activity of one or more monooxygenase activities with a substrate preference for feedstocks having carbon chain lengths of between about 12 and about 24 carbons (e.g., mixed chain length alkanes, mixed chain length fatty acids, soapstocks, the like and combinations thereof). In certain embodiments, the genetic modification increases the activity of a monooxygenase activity with a preference for fatty acids having a carbon chain-length distribution of between about 10 carbons and about 16 carbons.

As mentioned previously, the enzymes that carry out the monooxygenase activity are reduced by the activity of monooxygenase reductase, thereby regenerating the enzyme. Selection of a CPR for amplification in an engineered strain depends upon which P450 is amplified, in some embodiments. A particular CPR may interact preferentially with one or more monooxygenase activities, in some embodiments, but not well with other monooxygenases. A monooxygenase reductase from Candida strain ATCC750, two monooxygenase reductase activities from Candida strain ATCC20336 and a monooxygenase reductase activity from Bacillus megaterium are being evaluated for activity with the added and/or amplified monooxygenases described herein. Provided in the tables below are nucleotide sequences used to add or amplify monooxygenase and monooxygenase reductase activities.

Example 19: Amplification of Selected Beta Oxidation Activities

Described herein are methods of amplifying a POX5 beta oxidation activity. Substantially similar methods can be utilized to amplify different beta oxidation activities including non-POX (e.g., acyl-CoA oxidase) activities and/or acyl-CoA oxidase activities with altered substrate specificities, as described herein.

Construction of POX5 Amplified Strains

Plasmid pAA166 ($P_{POX4}POX5T_{POX4}$)

A PCR product containing the nucleotide sequence of POX5 was amplified from C. tropicalis 20336 genomic DNA using primers oAA540 and oAA541. The PCR product was gel purified and ligated into pCR-Blunt II-TOPO (Invitrogen), transformed into competent TOP10 E. coli cells (Invitrogen) and clones containing PCR inserts were sequenced to confirm correct DNA sequence. One such plasmid was designated, pAA165. Plasmid pAA165 was digested with BspQI and a 2-kb fragment was isolated. Plasmid pAA073 which contained a POX4 promoter and POX4 terminator was also digested with BspQI and gel purified. The isolated fragments were ligated together to generate plasmid pAA166. Plasmid pAA166 contains a $P_{POX4}POX5T_{POX4}$ fragment.

Plasmid pAA204 (Thiolase Deletion Construct)

A PCR product containing the nucleotide sequence of a short-chain thiolase (e.g., acetyl-coA acetyltransferase) was amplified from *C. tropicalis* 20336 genomic DNA using primers oAA640 and oAA641. The PCR product was gel purified and ligated into pCR-Blunt II-TOPO (Invitrogen), transformed into competent TOP10 *E. coli* cells (Invitrogen) and clones containing PCR inserts were sequenced to confirm correct DNA sequence. One such plasmid was designated, pAA184. A URA3 PCR product was amplified from pAA061 using primers oAA660 and oAA661. The PCR product was gel purified and ligated into pCR-Blunt II-TOPO (Invitrogen), transformed as described and clones containing PCR inserts were sequenced to confirm the correct DNA sequence. One such plasmid was designated pAA192. Plasmid pAA184 was digested with BglII/SalI and gel purified. Plasmid pAA192 was digested with BglII/SalI and a 1.5 kb fragment was gel purified. The isolate fragments were ligated together to create pAA199. An alternative $P_{URA3}$ PCR product was amplified from plasmid pAA061 using primers oAA684 and oAA685. The PCR product was gel purified and ligated into pCR-Blunt II-TOPO (Invitrogen), transformed as described and clones containing PCR inserts were sequenced. One such plasmid was designated, pAA201. Plasmid pAA199 was digested with SalI and gel purified. Plasmid pAA201 was digested with SalI and a 0.43 kb $P_{URA3}$ was gel purified. The isolated fragments were ligated to create plasmid pAA204 that contains a direct repeat of $P_{URA3}$.

Plasmid pAA221 ($P_{POX4}POX5T_{POX4}$ in Thiolase Deletion Construct)

A PCR product containing the nucleotide sequence of $P_{POX4}POX5T_{POX4}$ was amplified from plasmid pAA166 DNA using primers oAA728 and oAA729. The PCR product was gel purified and ligated into pCR-Blunt II-TOPO, transformed as described and clones containing PCR inserts were sequenced to confirm the sequence of the insert. One such plasmid was designated, pAA220. Plasmid pAA204 was digested with BglII, treated with shrimp alkaline phosphatase (SAP), and a 6.5 kb fragment was gel purified. Plasmid pAA220 was digested with BglII and a 2.7 kb fragment containing $P_{POX4}POX5T_{POX4}$ was gel purified. The isolated fragments were ligated to create plasmid pAA221.

Strain sAA617 ($P_{POX4}POX5T_{POX4}$ in sAA451)

Strain sAA451 is a ura-, partially β-oxidation blocked *Candida* strain (ura3/ura3 pox4a::ura3/pox4b::ura3 POX5/POX5). Plasmid pAA221 was digested with EcoRI to release a DNA fragment containing $P_{POX4}POX5T_{POX4}$ in a thiolase deletion construct. The DNA was column purified and transformed to strain sAA451 to plate on SCD-ura plate. After two days, colonies were streaked out on YPD plates, single colonies selected and again streaked out on YPD plates. Single colonies were selected from the second YPD plates and characterized by colony PCR. The insertion of $P_{POX4}POX5T_{POX4}$ in strain sAA451, disrupting the short-chain thiolase gene, was confirmed by PCR and one such strain was designated sAA617.

Strain sAA620

Strain sAA617 was grown overnight on YPD medium and plated on SCD+URA+5-FOA, to select for loop-out of URA3. Colonies were streaked out onto YPD plates twice as described for strain sAA617, and single colonies characterized by colony PCR. The loop-out of URA3 by direct repeats of PURA3 was confirmed by PCR. One such strain was designated sAA620. Strain sAA620 has one additional copy of POX5 under control of the POX4 promoter.

Plasmid pAA156

A PCR product containing the nucleotide sequence of CYP52A19 was amplified from *Candida* strain 20336 genomic DNA, using primers oAA525 and oAA526. The PCR product was gel purified and ligated into pCR-Blunt II-TOPO, transformed as described, and clones containing PCR inserts were sequenced to confirm correct DNA sequence. One such plasmid was designated, pAA144. Plasmid pAA144 was digested with BspQI and a 1.7-kb fragment was isolated. Plasmid pAA073, which includes a POX4 promoter and POX4 terminator, also was digested with BspQI and gel purified. The isolated fragments were ligated together to generate plasmid, pAA156. Plasmid pAA156 included $P_{POX4}CYP52A19T_{POX4}$ fragment and URA3.

Strain sAA496

Plasmid pAA156 was digested with ClaI and column purified. Strain sAA451 was transformed with this linearized DNA and plated on SCD-ura plate. Colonies were checked for CYP52A19 integration. Colonies positive for plasmid integration were further analyzed by qPCR to determine the number of copies of CYP52A19 integrated. One such strain, designated contained about 13 copies of the monooxygenase activity encoded by CYP52A19.

Strains sAA632 and sAA635

Strain sAA620 was transformed with linearized pAA156 DNA and plated on SCD-ura plates. Several colonies were checked for CYP52A19 integration. Colonies positive for plasmid integration were further analyzed by qPCR to determine the number of copies of CYP52A19 integrated. One such strain, designated sAA632 contained about 27 copies of the monooxygenase activity encoded by CYP52A19. Another strain, designated sAA635, contained about 12 copies of the monooxygenase activity encoded by CYP52A19.

Example 20: Cloning of *C. tropicalis* ACH Genes

ACH PCR product was amplified from *C. tropicalis* 20336 genomic DNA using primers oAA1095 and oAA1096, shown in TABLE 15. The PCR product was gel purified and ligated into pCR-Blunt II-TOPO (Invitrogen), transformed into competent TOP10 *E. coli* cells (Invitrogen) and clones containing PCR inserts were sequenced to confirm correct DNA sequence.

Sequence analysis of multiple transformants revealed the presence of allelic sequences for the ACH gene, which were designated ACHA and ACHB. A vector containing the DNA sequence for the ACHA allele was generated and designated pAA310 (see FIG. 51). A vector containing the DNA sequence for the ACHB allele was generated and designated pAA311.

TABLE 15

| Primer | sequence (SEQ ID NOS 239-240, respectively, in order of appearance) |
|---|---|
| oAA1095 | CACACACCCGGGATGATCAGAACCGTCCGTTATCAAT |
| oAA1096 | CACACATCTAGACTCTCTTCTATTCTTAATTGCCGCTTC CACTAAACGGCAAAGTCTCCACG |

Example 21: Cloning of *C. tropicalis* FAT1 Gene

FAT1 PCR product was amplified from *C. tropicalis* 20336 genomic DNA using primers oAA1023 and oAA1024, shown in TABLE 16. The PCR product was gel purified and ligated into pCR-Blunt II-TOPO (Invitrogen), transformed into competent TOP10 E. coli cells (Invitrogen) and clones containing PCR inserts were sequenced to confirm correct DNA sequence. A vector containing the DNA sequence for the FAT1 gene was designated pAA296.

TABLE 16

| Primer | sequence (SEQ ID NOS 241-242, respectively, in order of appearance) |
|---|---|
| oAA1023 | GATATTATTCCACCTTCCCTTCATT |
| oAA1024 | CCGTTAAACAAAAATCAGTCTGTAAA |

Example 22: Cloning of C. tropicalis ARE1 and ARE2 Genes

ARE1 and ARE2 PCR products were amplified from C. tropicalis 20336 genomic DNA using primers oAA2006/oAA2007 and oAA1012/oAA1018, respectively, shown in TABLE 17. The PCR products were gel purified and ligated into pCR-Blunt II-TOPO (Invitrogen), transformed into competent TOP10 E. coli cells (Invitrogen) and clones containing PCR inserts were sequenced to confirm correct DNA sequence. A vector containing the DNA sequence for the ARE1 gene was designated pAA318. A vector containing the DNA sequence for the ARE2 gene was designated pAA301.

TABLE 17

| Primer | sequence (SEQ ID NOS 243-246, respectively, in order of appearance) |
|---|---|
| oAA1012 | ATGTCCGACGACGAGATAGCAGGAATAGTCAT |
| oAA1018 | TCAGAAGAGTAAATACAACGCACTAACCAAGCT |
| oAA2006 | ATGCTGAAGAGAAAGAGACAACTCGACAAG |
| oAA2007 | GTGGTTATCGGACTCTACATAATGTCAACG |

Example 23: Construction of an Optimized TESA Gene for Expression in C. tropicalis The gene sequence for the E. coli TESA gene was optimized for expression in C. tropicalis by codon replacement. A new TESA gene sequence was constructed using codons from C. tropicalis with similar usage frequency for each of the codons in the native E. coli TESA gene (avoiding the use of the CTG codon due to the alternative yeast nuclear genetic code utilized by C. tropicalis). The optimized TESA gene was synthesized with flanking BspQI restriction sites and provided in vector pIDTSMART-Kan (Integrated DNA Technologies). The vector was designated as pAA287. Plasmid pAA287 was cut with BspQI and the 555 bp DNA fragment was gel purified. Plasmid pAA073 also was cut with BspQI and the linear DNA fragment was gel purified. The two DNA fragments were ligated together to place the optimized TESA gene under the control of the C. tropicalis POX4 promoter. The resulting plasmid was designated pAA294.

Example 24: Cloning of C. tropicalis DGA1 Gene

DGA1 PCR product was amplified from C. tropicalis 20336 genomic DNA using primers oAA996 and oAA997,
shown in TABLE 18. The PCR product was gel purified and ligated into pCR-Blunt II-TOPO (Invitrogen), transformed into competent TOP10 E. coli cells (Invitrogen) and clones containing PCR inserts were sequenced to confirm correct DNA sequence. A vector containing the DNA sequence of the DGA1 gene was designated pAA299.

TABLE 18

| Primer | Sequence (SEQ ID NOS 247-248, respectively, in order of appearance) |
|---|---|
| oAA996 | ATGACTCAGGACTATAAAGACGATAGTCCTACGTCCACTGAGTTG |
| oAA997 | CTATTCTACAATGTTTAATTCAACATCACCGTAGCCAAACCT |

Example 25: Cloning of C. tropicalis LRO1 Gene

LRO1 PCR product was amplified from C. tropicalis 20336 genomic DNA using primers oAA998 and oAA999, shown in TABLE 19. The PCR product was gel purified and ligated into pCR-Blunt II-TOPO (Invitrogen), transformed into competent TOP10 E. coli cells (Invitrogen) and clones containing PCR inserts were sequenced to confirm correct DNA sequence. A vector containing the DNA sequence of the LRO1 gene was designated pAA300.

TABLE 19

| Primer | sequence (SEQ ID NOS 249-250, respectively, in order of appearance) |
|---|---|
| oAA998 | ATGTCGTCTTTAAAGAACAGAAAATC |
| oAA999 | TTATAAATTTATGGCCTCTACTATTTCT |

Example 26: Cloning of C. tropicalis ACS1 Gene and Construction of Deletion Cassette ACS1 PCR product was amplified from C. tropicalis 20336 genomic DNA using primers oAA951 and oAA952, shown in TABLE 20. The PCR product was gel purified and ligated into pCR-Blunt II-TOPO (Invitrogen), transformed into competent TOP10 E. coli cells (Invitrogen) and clones containing PCR inserts were sequenced to confirm the DNA sequence. One such plasmid was designated pAA275. Plasmid pAA280 was digested with BamHI to release a 2.0 kb $P_{URA3}$ URA3$T_{URA3}P_{URA3}$ cassette. Plasmid pAA275 was digested with BglII and gel purified. The two pieces were ligated together to generate plasmid pAA276 and pAA282. Plasmid pAA276 and pAA282 have the $P_{URA3}$ URA3$T_{URA3}P_{URA3}$ cassette inserted into the ACS gene in opposite orientations.

TABLE 20

| Primer | sequence (SEQ ID NOS 251-252, respectively, in order of appearance) |
|---|---|
| oAA951 | CCTACTTCCACAGCTTTAATCTACTATCAT |
| oAA952 | TTTAAGAAAACAACTAAGAGAAGCCAC |

Example 27: Construction of Strain sAA722 (pox4a::ura3/pox4b::ura3 POX5/POX5 ACS1/acs1::P$_{URA3}$URA3T$_{URA3}$P$_{URA3}$)

Plasmid pAA276 was digested with BamHI/XhoI and column purified. Strain sAA329 (ura3/ura3 pox4a::ura3/pox4b::ura3 POX5/POX5) was transformed with the linearized DNA and plated on SCD-ura plate. Several colonies were checked for ACS1 disruption. One such strain was designated sAA722.

Example 28: Construction of Strain sAA741 (pox4a::ura3/pox4b::ura3 POX5/POX5 ACS1/acs1::P$_{URA3}$)

Strain sAA722 was grown in YPD media overnight and plated on 5-FOA plate. Colonies that grew in the presence of 5-FOA were PCR screened for the looping out of the URA3 gene leaving behind only the URA3 promoter (P$_{URA3}$) in the ACS1 site. Out of 30 colonies analyzed, only one strain showed the correct genetic modification. The strain was designated sAA741.

Example 29: Construction of Strain sAA776 (pox4a::ura3/pox4b::ura3 POX5/POX5 acs1::P$_{URA3}$URA3T$_{URA3}$P$_{URA3}$/acs1::P$_{URA3}$)

Plasmid pAA282 was digested with BamHI/XhoI and column purified. Strain sAA741 (see Example 28) was transformed with the linearized DNA and plated on SCD-ura plate. Several colonies were checked for double ACS1 knockout by insertional inactivation. One such strain was designated sAA776.

Example 30: Construction of Strain sAA779 (pox4a::ura3/pox4b::ura3 POX5/POX5 acs1::P$_{URA3}$/acs1::P$_{URA3}$)

Strain sAA776 (see Example 29) was grown in YPD media overnight and plated on 5-FOA plates. Colonies that grew in the presence of 5-FOA were PCR screened for the looping out of the URA3 gene leaving behind only the URA3 promoter (P$_{URA3}$) in both ACS1 copies. One such strain was designated sAA779.

Example 31: Construction of Strain sAA811 (pox4a::ura3/pox4b::ura3 POX5/POX5 acs1::P$_{URA3}$/acs1::P$_{URA3}$ ura3::3xP$_{POX4}$P450A19)

Plasmid pAA156 containing a P450A19 integration cassette was digested with ClaI and column purified. Strain sAA779 (see Example 30) was transformed with the linearized DNA and plated on SCD-ura plate. Several colonies were checked for P450A19 integration. From those colonies, qPCR was performed to check the copy number of P450A19 integration. One strain, designated sAA811, contained 3 copies of P450A19.

Example 32: Construction of Strain sAA810 (pox4a::ura3/pox4b::ura3 POX5/POX5 acs1::P$_{URA3}$/acs1::P$_{URA3}$ ura3::5xP$_{POX4}$P450A19 ura3::8xP$_{POX4}$TESA)

Plasmid pAA156 containing a P450-A19 integration cassette was digested with ClaI and column purified. Plasmid pAA294 containing a TESA integration cassette also was digested with ClaI and column purified. Strain sAA779 was cotransformed with both linearized DNAs and plated on SCD-ura plate. Several colonies were checked for both P450A19 integration and TESA integration. Colonies that were positive for both TESA and P450A19 were further analyzed by qPCR. qPCR was performed to check the copy number of the P450A19 and TESA integration events. One strain, designated sAA810, contained 5 copies of P450A19 and 8 copies of TESA.

Example 33: General Techniques & Methods (Used for Examples 34-55)

Growth Media, Reagents and Conditions

YPD, ScD-ura media and plates, and 5-FOA containing plates were made as described in Methods in Yeast Genetics: a Cold Spring Harbor Laboratory Manual/David C. Amberg, Daniel J. Burke, Jeffrey Strathern, —2005 ed.).

SP92+glycerol was made by adding 6.7 g of Bacto yeast nitrogen base without amino acids (BD, Franklin Lakes, N.J., USA), 3.0 g of Bacto yeast extract (BD, Franklin Lakes, N.J., USA), 3.0 g of ammonium sulfate, 1.0 g of potassium phosphate monobasic, 1.0 g of potassium phosphate dibasic, and 75 g of glycerol to water to a final volume of one liter. The media was then filtered sterilized.

TB-low N Media was made by adding 1.7 g Bacto yeast nitrogen base without ammonium sulfate, 3 g of Bacto yeast extract, 1 g of potassium phosphate monobasic and 1 g potassium phosphate dibasic per liter of water. The media was filtered sterilized.

Overnight cultures were typically grown in 2 to 5 ml of either ScD-ura media or YPD media in standard culture tubes at 30 C on a shaker at about 250 rpm.

Molecular Methods

Gel purifications of DNA fragments were done as recommended by the manufacturer using either the GeneJET Gel Extraction Kit (Fermentas Inc, Glen Burnie, Md., USA) or the Zymoclean Gel DNA Recovery Kit (ZymoResearch, Irvine, Calif., USA).

PCR was performed using either PFU Ultra II DNA Polymerase (Agilent Technologies, Santa Clara, Calif., USA), Taq DNA polymerase (New England Biolabs, Ipswich, Mass., USA), DreamTaq PCR Master Mix (Fermentas Inc, Glen Burnie, Md., USA) or Quick Load Midas Mix (Monserate, San Diego, Calif., USA). Each enzyme was used according to the manufacturer's instructions.

Restriction enzyme digestions were conducted as recommended by each manufacturer (New England Biolabs, Ipswich, Mass., USA or Fermentas Inc., Glen Burnie, Md., USA). DNA ligations were conducted using either the Rapid Ligation Kit (Fermentas Inc., Glen Burnie, Md., USA) or using T4 DNA Ligase (New England Biolabs, Ipswich, Mass., USA) according to the manufacturer's instructions.

Yeast transformations were performed as described in Example 10.

Genomic DNA Preparation

The URA3 gene was obtained from genomic DNA of Candida yeast culture ATCC20336. Genomic DNA from Candida strain ATCC20336 was prepared as follows: About 1.5 ml of an overnight culture of cells was and the pellet was resuspended in about 200 µl of a solution containing 2% Triton X-100, 1% SDS, 100 mM NaCl, 10 MM Tris pH 8.0, and 1 mM EDTA. About 200 µl of acid washed glass beads were added with about 200 µl of phenol:chloroform:isoamyl alcohol (25:24:1) at a pH of about 8.0. The sample was vortexed for about 2 minutes after which about 200 µl of water was added. The sample was then centrifuged at 13000 rpm for about 10 minutes. The aqueous layer was transferred to a new microcentrifuge tube and an equal volume of chloroform:isoamyl alcohol (24:1) solution was added. This sample was vortexed for 10 seconds and then centrifuged at 13000 rpm for about 2 minutes. The aqueous layer was transferred to a new microfuge tube and 1 ml of ethanol was added. The tube was then placed at −80° C. for about 15 minutes and then spun at 13000 rpm for 15 minutes to pellet the DNA The DNA was washed with 70% ethanol and air-dried. The DNA was then resuspended in about 500 µl of water.

Genomic DNA for *Klyveromyces lactis* (ATCC8585) was purchased from the American Type Culture Collection (Manassas, Va., USA).

To calculate gene copy number, a qPCR method was used as described by Jin et al (Appl. Environ. Microbiol. January 2003 vol. 69, no. 1, 495-503). qPCR was performed according to the manufacturer's instructions using either the Brilliant III Ultra-Fast SYBR® Green QPCR Master Mix (Agilent Technologies, Englewood, Colo., USA) or the QuantiTect Multiplex PCR NoROX Kit (Qiagen). Genomic DNA from *Candida* strain ATCC20336 or plasmid DNA containing the actin gene from ATCC20336 and the gene of interest were used as standards.

Primers and probes used throughout these Examples were made via standard DNA synthesis techniques by Integrated DNA Technologies (Coralville, Iowa, USA).

Example 34: Construction of Cloning Plasmid AA073

The plasmid pAA073 was designed to contain the POX4 promoter and terminator from *Candida* strain ATCC20336 (this strain is also referred to herein as strain sAA001). This plasmid was derived from the publicly available plasmid pUC19 which contains an ampicillin resistance marker. pAA073 was designed to have two SapI restriction enzyme sites located between the POX4 promoter and terminator which allows unidirectional cloning of any gene of interest in tandem with the POX4 promoter. The *Candida* strain ATCC20336 URA3 gene including the open reading frame and the endogenous regulatory regions was also placed into pAA073 as a selection marker for transformants. Plasmid pAA073 allows the direct integration of multiple copies of any gene of interest by digesting the plasmid with a unique restriction enzyme such as SpeI, ClaI or BstZ17I. These multiple cloning sites for are contained in the URA3 auxotrophic marker region and can be selectively be used to avoid cutting the gene of interest (i.e., the DNA sequence for the gene of interest can be searched for particular restriction enzyme cut sites and those enzymes can be avoided). In addition, this plasmid can serve as a template to create an antibiotic free-DNA cassette containing the gene of interest and the POX 4 regulatory regions inserted between the 3' and 5' regions of the URA3 gene; this cassette can be PCR amplified using the plasmid as a template, and the isolated PCR product can be inserted into any microorganism strain.

A diagram of pAA073 is set forth in FIG. 18 and the sequence of pAA073 is set forth as SEQ ID NO: 160.

Example 35: Generic Procedure for Creating Yeast Transformation Plasmids and Integration Cassettes and Creation of a ZWF1 Gene Transformation Plasmid One of two procedures was used to generate DNA constructs useful to make transformed *Candida* yeast strains that contained either amplified levels of endogenous genes or exogenous genes inserted into the genomic DNA of the *Candida* yeast host. The following endogenous genes were amplified from genomic *Candida* ATCC20336 genomic DNA: fatty alcohol dehydrogenase ("ADH")-ADH1, 2, 3, 4, 5, 7 and 8; ZWF1 (glucose-6-phosphate dehydrogenase); FAT1 (fatty acyl transporter 1); PEX11 (peroxisomal biogenesis factor 11); HFD1 and HFD2 (human fatty aldehyde dehydrogenase 1 and 2), CPRB (cytochrome p450 reductase B), P450A12-A20 and P450D2 (cytochrome p450 oxidases 12-20 and D2); FAT1 (fatty acyl transporter 1); and IDP2 (cytoplasmic isocitrate dehydrogenase NADP+). The gene GDP1 (glyceraldehyde 3 phosphate dehydrogenase) was obtained from *Klyveromyces lactis* genomic DNA and is sometimes referred to as "KlGDP1". In the case of the ADH1 gene, the alleles were separately cloned; these alleles are referred to as "ADH1-1 and ADH1-2. In addition, the ADH1 allele 1 was cloned as the "short" version and thus is referred to as "ADH1-1short"; the ADH1 allele 2 was cloned as both short and regular versions and these genes are referred to as "ADH1-2-short" and "ADH1-2". For ADH2, two separate genes have been identified; each of them was cloned and amplified herein and they are referred to as "ADH2a" and "ADH2b". The first procedure ("Procedure 1") resulted in generating a plasmid that was directly transformed into yeast; this plasmid contained the antibiotic resistance gene kanamycin.

The second procedure ("Procedure 2") included all of the steps of the first procedure, but added an additional final step to remove the antibiotic resistance gene such that the transformed *Candida* strain did not contain any exogenous antibiotic resistance genes.

The first step in Procedure 1 was to amplify the gene of interest from *Candida* strain ATCC20336 genomic DNA using appropriately designed primers and standard PCR techniques as set forth above. The sequence of each primer is set forth in TABLE 25, 26 and 27. The amplified gene of interest was then inserted into plasmid pCR-Blunt II-Topo (Life Technologies, Carlsbad, Calif., USA) using standard techniques recommended by the manufacturer. The sequence of the gene or interest was then verified using standard sequencing techniques. The name of the resulting plasmid for each gene of interest is set forth in TABLE 21 under the column labeled "Plasmid 1". Next, Plasmid 1 was digested with appropriate restriction enzymes to isolate the gene of interest insert. This gene of interest was then inserted into pAA073 (described in Example 35) to create "Plasmid 3" for each gene of interest. The name of each Plasmid 3 for each gene of interest is set forth in TABLE 21 in the column labeled "Plasmid 3". It is possible to clone the PCR fragment directly into Plasmid 3 thereby avoiding construction of Plasmid 1. Each resulting Plasmid 3 contained the gene of interest under the control of the POX 4 promoter and terminator, the URA3 gene and regulatory regions, and the ampicillin resistance marker gene. For some constructs, this Plasmid 3 was cut in the URA3 gene and the entire linearized plasmid was transformed into *Candida* strain ATCC20336. Such transformed *Candida* strains contained the ampicillin resistance gene.

In the second procedure, the entire first procedure was followed. After creation of Plasmid 3 however, two PCR reactions were conducted. The first reaction was designed to amplify only the 3' region of the URA3 gene; the amplified fragment was then gel purified. A second PCR reaction amplified, as a single fragment, the POX4 promoter, the gene of interest, the POX4 terminator and the 5' region of the URA3 gene. This fragment was also gel purified. The two fragments were fused together by PCR and this PCR product was inserted into plasmid pCR-Blunt II-Topo, this plasmid was transformed into *E coli* cells and colonies were then selected for sequence verification of the plasmid insert. The plasmid containing the correct sequence was named and is referred to as "Plasmid 4" in TABLE 21. Plasmid 4 was then used for PCR amplification of the entire URA3'-POX4 promoter-gene of interest-POX4 terminator-URA5' construct and this construct was then used to transform *Candida* cells. The resulting transformed cells contained the gene of interest but no antibiotic resistance genes were introduced into the strain.

Preparation of a ZWF1 Transformation Plasmid

Procedure 1 described immediately above was used to create this plasmid. The ZWF1 gene was PCR amplified from *Candida* strain ATCC20336 genomic DNA using primers oAA831 and oAA832. The PCR fragment was gel purified, cloned into the plasmid pCR-Blunt II-Topo (Life Technologies, Carlsbad, Calif., USA) using standard techniques recommended by the manufacturer and the sequences were verified. The plasmid pCR-Blunt II-TOPO contains a kanamycin resistance gene. The resulting plasmid containing the gene encoding the ZWF1 polypeptide was named pAA246 ("Plasmid 1"). The open reading frame of ZWF1 was then cloned as a Sap1 fragment into pAA073. The resulting plasmid was named pAA253 ("Plasmid 3").

Example 36: Creation of an Antibiotic Free Yeast Integration Cassette for the ADH2a Gene Procedure 2 described in the previous Example was used to create an integration cassette to introduce the gene encoding ADH2a into *Candida* yeast cells. The ADH2a gene was PCR amplified using standard procedures from *Candida* strain genomic DNA using primers oAA3018 and oAA3019. The PCR fragment was gel purified, cloned into pCR-Blunt II-Topo (Invitrogen, Carlsbad, Calif., USA) using standard cloning techniques and the sequence was verified. Plasmid 1 containing the correct sequence was named pAA671. The ADH2A fragment from pAA671 was then subcloned into pAA073 using SapI restriction enzyme sites to form Plasmid 3, referred to as pAA683, which places the ADH2a open reading frame under the control of the POX4 promoter and POX4 terminator. An antibiotic-free cassette was then created by assembly PCR. The 3' region of URA3 and a separate fragment containing the POX4 promoter, ADH2a open reading frame, POX4 terminator, and 5' region URA3 were each amplified using PCR with either primers oAA2206 and oAA2207, or with primers oAA2208 and oAA2209, respectively. The PCR products were gel-purified, combined and re-amplified using primers oAA2206 and oAA2209. The resulting PCR fragment was cloned into pCR-Blunt II Topo (Life Technologies, Carlsbad, Calif., USA) and sequence verified. A plasmid with the correct sequence ("Plasmid 4") was named pAA711.

Example 37: Creation of an Antibiotic Free Yeast Integration Cassette for the *K. lactis* GDP1 Gene KlGDP1 was cloned from genomic DNA at the same time that it was mutagenized to replace an internal CUG codon to another leucine encoding codon by replacing guanosine at position 774 with an adenosine. The 5' region or 3' region of KlGDP1 was PCR amplified from *K. lactis* genomic DNA using either oAA2457 and oAA2459 or oAA2458 and oJHR4, respectively. The PCR fragments were gel purified and combined to be used as template for a PCR amplification with oAA2457 and oJHR4. The PCR fragment was gel purified and cloned into pCR-Blunt II-TOPO as recommended by the manufacturer. Plasmids were sequenced and a plasmid with the right sequence named pAA541. This plasmid was the template for the PCR with primers oAA2854 and oAA2855 to create plasmid pAA578. All other procedures for preparing this cassette were as described for the ADH2a using appropriate primers for cloning and gene amplification.

>GDP1, Kl—SEQ ID NO: 71

Example 38: Other Gene Amplification Cassette Constructs

In addition to ZWF1 and ADH2a, several other genes were placed into either transformation plasmids or amplification cassettes using either Procedure 1 (transformation plasmids) or Procedure 2 (amplification cassettes) above. The genes included in these plasmids or cassettes are set forth in TABLE 21. The genes that were inserted into antibiotic-free amplification cassettes have a Plasmid 4 on the TABLE 21; those genes that were put into transformation plasmids do not have Plasmid 4. Tables 25-28 list some oligonucleotides and oligonucleotide sequences that were used to subclone and clone some of the genes described in the Examples herein.

Example 39: Creation of a *Candida* Strain Overexpressing ZWF1

Plasmid pAA253 was digested with the restriction enzyme ClaI. The linearized plasmid was transformed into *Candida* strain sAA103 using standard transformation procedures. Transformants were selected by growth in ScD-ura plates using standard procedures. Plates were streaked to generate single colonies and transformants were verified by PCR and sequence analysis. ZWF1 copy number was determined using qPCR. A strain with approximately six copies of ZWF1 was designated as sAA1233.

Example 40: Creation of a *Candida* Strain Overexpressing ADH2a

A 3'URA3-$P_{POX4}$-ADH2A-$T_{POX4}$-5'URA3 fragment was constructed by using plasmid pAA711 as a template and PCR amplifying the desired region of the plasmid with of primers oAA2206 and oAA2209. The PCR fragment was gel-purified and transformed into *Candida* strain sAA103. Transformants were selected by growth in ScD-ura plates. Colonies were streaked for single isolates and transformant isolates were verified by PCR. Gene copy number was then determined by qPCR. A strain was identified with approximately seven copies of $P_{POX4}$-ADH2A-$T_{POX4}$4 and was named sAA1803.

Example 41: Creation of Additional *Candida* Strains

Several other transformation plasmids or amplification cassettes were generated and were transformed in to *Candida* strain sAA103 using Procedure 1 or Procedure 2 described above to create novel plasmids and *Candida* strains. The genes, plasmid names and strain names are set forth in TABLE 21.

TABLE 21

| Gene | Plasmid 1 | Plasmid 2 | Plasmid 3 | Plasmid 4 | Strain |
|---|---|---|---|---|---|
| | | Plasmid 2 | | | |
| ADH1-1-short | pAA698 | | | | |
| ADH1-2 | pAA670 | | pAA682 | pAA716 | sAA1817 |
| ADH1-2-short | pAA697 | | pAA700 | pAA728 | sAA1848 |
| ADH2A | pAA671 | | pAA683 | pAA711 | sAA1803 |
| ADH2B | pAA672 | | pAA691 | pAA717 | sAA1805 |
| ADH7 | pAA673 | | pAA692 | pAA714 | sAA1841 |
| ADH5 | pAA674 | | pAA693 | pAA718 | sAA1844 |
| ADH3 | pAA675 | pAA715 | pAA730 | pAA739 | sAA1901 |
| ADH4 | pAA676 | | pAA694 | pAA719 | sAA1839 |
| SFA1 | pAA680 | | pAA699 | pAA727 | sAA1808 |
| ADH8 | pAA729 | | pAA738 | pAA741 | sAA1904 |
| ZWF1 | pAA246 | | pAA253 | | sAA1233 |
| FAT1 | | | pAA635 | | |
| PEX11 | N/A | | pAA336 | | |
| HFD1 | pAA677 | | | | |
| HFD2 | pAA678 | | pAA695 | pAA712 | sAA1819 |
| CPRB | N/A | | pAA218 | pAA391 | |
| P450 A12 | pAA139 | | pAA151 | | |
| P450 A13 | pAA140 | | pAA152 | | |
| P450 A14 | pAA141 | | pAA153 | pAA367 | |
| P450 A15 | | | pAA160 | | |
| P450 A16 | | | pAA161 | | |
| P450 A17 | pAA142 | | pAA154 | | |
| P450 A18 | pAA143 | | pAA155 | | |
| P450 A19 | pAA144 | | pAA156 | pAA392 | |
| P450 A20 | pAA145 | | pAA157 | | |
| P450 D2 | pAA146 | | pAA158 | | |
| FAT1 S244A | | | pAA637 | | |
| FAT1 D495A | | | pAA639 | | |
| IDP2 | | | pAA462 | | sAA1306 |
| KlGDP1 | pAA578 | | pAA581 | pAA592 | sAA1485 |

Note:
"Plasmid 1", "Plasmid 3", and "Plasmid 4" are as described in Example 35; "Plasmid 2" was generated only for the gene alcohol dehydrogenase 3 in which the guanosine at position 600 was mutated to an adenosine by site directed mutagenesis. To prepare this plasmid, 30 to 50 ng of pAA675 was used as template in a 50 µl PCR reaction using primers oAA3073 and oAA3074 and PFU Ultra II DNA Polymerase (Agilent Technologies, Santa Clara, California, USA) as recommended by manufacture. After the PCR was completed, 20 units of DpnI (New England Biolabs, Ipswich, Massachusetts, USA) was added to the PCR reaction and incubated for 2 hours at 37° C. 5 µl of the reaction was used to transform DH5α cells (Monserate Biotechnology, San Diego CA USA) as recommended by manufacture. The resulting plasmids were sequence verified, and a plasmid with the right sequence was named pAA715.

Example 42: Creation of Two FAT1 Mutant Genes

Two mutants of the FAT1 gene were created in an attempt to reduce the acyl CoA synthetase activity of the enzyme while maintaining its fatty acid transport activity. The first mutant substituted an alanine at position 244 for the native serine; the second mutant substituted an alanine at position 495 for the native aspartic acid.

To prepare a gene containing the S244A mutation of FAT1, oligonucleotides oAA2839 and oAA2805 were used to amplify the 5' end of the native FAT1 gene from *Candida* ATCC20336 genomic DNA, while oligonucleotides oAA2804 and oAA2875 were used to amplify the 3' end of the gene. Both products were gel purified and used as templates for a second round of PCR using oligonucleotides oAA2839 and oAA2875. The resultant PCR product was digested along with pAA073 using the restriction enzyme BspQI (New England Biolabs) and the gel purified products were ligated with T4 DNA ligase (Fermentas). The ligations were transformed into *E. coli* DH5α (Montserrat) and plated on LB ampicillin. Minipreps (Qiagen) were completed on several colonies and sequence confirmed.

The above process was repeated for the FAT1 D495A mutant gene using oAA2839 and oAA2842 for the 5' end of the gene and oAA2841 and oAA2875 for the 3' end. The two ends of the gene were used as described with oAA2839 and oAA2875 to make the full product, digested, cloned and verified as above.

Each mutant gene was inserted into plasmid pAA073.

Example 43: Preparation of *Candida* Strains Containing Multiple Amplified Genes In addition to creating novel *Candida* strains in which a single gene was amplified, several strains were created with more than one gene amplified. These strains were generated by co-transforming strain sAA103 with the individual transformation plasmids or amplification cassettes for each of the genes of interest. TABLE 22 below sets forth the name of each such *Candida* strain created and the genes transformed into the strain.

TABLE 22

| Strain | Gene 1 | Source of Gene | Gene 2 | Source of Gene | Gene 3 | Final Plasmid |
|---|---|---|---|---|---|---|
| sAA1082 | CPRB | pAA391 | P450 A19 | pAA392 | | |
| sAA1569 | CPRB | pAA391 | p450 A14 | pAA367 | | |
| sAA1633 | CPRB | pAA391 | p450 A19 | pAA392 | ZWF1 | pAA246 |
| sAA1644 | CPRB | pAA391 | p450 A19 | pAA391 | IDP2 | pAA462 |
| sAA1304 | CPRB | pAA391 | p450 A19 | pAA392 | | |

Example 44: Creation of a FAT1 Knockout Strain

To create a *Candida* strain with decreased FAT1 gene expression, knock out cassettes for each FAT 1 allele were generated. For the first allele, the 5' homology region (nucleotides 27 to 488 of the open reading frame of FAT1) was amplified using primers oAA2055 and oAA2056 with *Candida* strain ATCC20336 genomic DNA as a template. The 3' homology region (consisting of nucleotides 1483 to 1891 of the FAT1 open reading frame) was amplified using primers oAA2069 and oAA2060 from the same genomic DNA. A cassette containing the URA3 marker with the promoter repeated at the 3' end was amplified from pAA298 to contain overlaps with both homology regions with oAA2057 and oAA2068. These three DNA fragments pieces were then used in a subsequent PCR reaction to generate the deletion cassette using oligos oAA2055 and oAA2060. The PCR purified cassette was then transformed into strain sAA103 and transformants verified by PCR to obtain sAA919. This strain was plated on 5FOA to cure the URA3 marker ad was verified by PCR. This strain without URA3 was designated as sAA986.

The second FAT1 allele disruption cassette was generated as follows: A 5' homology region (nucleotides 487 to 951 of the open reading frame) was amplified using primers oAA2070 and oAA2071. A 3' homology region (nucleotides 987 to 1439 of the open reading frame) was amplified using primers oAA2074 and oAA2075 and *Candida* ATCC20336 genomic DNA as a template. A cassette containing the URA3 marker with the promoter repeated at the 3' end was constructed to have overlaps with homology to primers oAA2072 and oAA2073. The three fragments were then used in a subsequent PCR reaction to generate the deletion cassette using oligos oAA2070 and oAA2075. This purified product was then used to transform sAA986, and transformants were verified by PCR as having the second allele disrupted. A strain with the correct genotype was named sAA1000. This strain was plated on 5FOA and was verified for removal of the URA3 marker using PCR. This strain was designated as sAA1182.

Example 45: Creation of a FAT1/ACS1 Double Deletion Strain

Functional POX5 alleles were restored in *Candida* strain sAA003 by transformation of sAA003 with POX5 linear DNA to replace the URA3-disrupted loci with a functional allele. A 2,584 bp DNA fragment was amplified by PCR using primers oAA0179 and oAA0182 that contained the POX5 ORF as well as 456 bp upstream and 179 bp downstream of the ORF using plasmid pAA049 as template. The purified PCR product was used to transform competent sAA003 cells which were plated on YNB-agar plates supplemented with dodecane vapor as the carbon source (e.g., by placing a filter paper soaked with dodecane in the lid of the inverted petri dish) and incubated at 30° C. for 4-5 days. Colonies growing on dodecane as the sole carbon source were re-streaked onto YPD-agar and incubated at 30° C. Single colonies were grown in YPD cultures and used for the preparation of genomic DNA. PCR analysis of the genomic DNA prepared from the transformants was performed with oligos oAA0179 and oAA0182. An ura3-disrupted POX5 would produce a PCR product of 4,784 bp while a functional POX5 would produce a PCR product of 2,584 bp. In the resulting strain, sAA235, a PCR product of 2,584 bp was amplified indicating that both POX5 alleles had been functionally restored. An unintended consequence of the selection strategy (YNB-agar with dodecane) was that the cells reverted back to an Ura+ phenotype. Without being limited by any theory, it is believed the absence of uracil in the solid media and the replacement of the only functional URA3 forced the cells to mutate one of the other ura3 loci back to a functional allele. Plasmid pAA276 was digested with BamHI/XhoI and column purified. Strain sAA329 (ura3/ura3 pox4a::ura3/pox4b::ura3 POX5/POX5) was transformed with the linearized DNA and plated on SCD-ura plate. Several colonies were checked for ACS1 disruption. One such strain was designated sAA722.

Strain sAA722 was grown in YPD media overnight and plated on 5-FOA plate. Colonies that grew in the presence of 5-FOA were PCR screened for the looping out of the URA3 gene leaving behind only the URA3 promoter ($P_{URA3}$) in the ACS1 site. Out of 30 colonies analyzed, only one strain showed the correct genetic modification. The strain was designated sAA741.

Plasmid pAA282 was digested with BamHI/XhoI and column purified. Strain sAA741 was transformed with the linearized DNA and plated on SCD-ura plate. Several colonies were checked for double ACS1 knockout by insertional inactivation. One such strain was designated sAA776.

Strain sAA776 was grown in YPD media overnight and plated on 5-FOA plate. Colonies that grew in the presence of 5-FOA were PCR screened for the looping out of the URA3 gene leaving behind only the URA3 promoter (PURA3) in both ACS1 gene alleles. One such strain was named sAA779. The full-length coding sequence of the Fat1 gene was amplified from Candid strain ATCC20336 genomic DNA using primers oAA1023 and oAA1024. The 2,086 bp PCR product was gel purified and ligated into pCR-Blunt II-TOPO (Invitrogen), transformed into competent TOP10 *E. coli* cells (Invitrogen) and clones containing PCR inserts were sequenced to confirm correct DNA sequence. One such plasmid was named pAA296.

Deletion of each FAT1 allele was achieved by transforming cells with linear DNA cassettes constructed by overlap extension PCR (OE-PCR). The deletion cassette for the first FAT1 allele in sAA779 was created from three DNA fragments. The first DNA fragment (FAT1 5' homology) was amplified from plasmid pAA296 using primers oAA2055 and oAA2056. The second DNA fragment (PURA3URA3TURA3PURA3) was amplified from plasmid pAA298 using primers oAA2057 and oAA2068. A diagram of plasmid pAA298 is set forth in FIG. 19 and the sequence of this plasmid is set forth as SEQ ID NO: 161.

>PAA298—SEQ ID NO: 161

The third DNA fragment (FAT1 3' homology) was amplified from plasmid pAA296 using primers oAA2069 and oAA2060. The location of primer annealing sites in pAA296 that amplify FAT1 DNA fragments are shown in FIG. 59. All three DNA fragments were combined in the same reaction to generate the full-length deletion cassette by OE-PCR using primers oAA2055 and oAA2060. Strain sAA779 was transformed with the full-length deletion cassette and plated on SCD-Ura plate. Several colonies were screened by PCR for integration of the deletion cassette at the first FAT1 allele. One such strain was named sAA865.

Strain sAA865 was grown in YPD media overnight and plated on 5-FOA plate. Colonies that grew in the presence of 5-FOA were PCR screened for the looping out of the URA3 gene leaving behind only the URA3 promoter (PURA3) in the first FAT1 allele. One such strain was named sAA869.

The deletion of the second FAT1 allele in sAA869 was performed by transformation with a deletion cassette created by OE-PCR. The deletion cassette for the second FAT1 allele was constructed from three DNA fragments. The first DNA fragment (FAT1 5' homology) was amplified from plasmid pAA296 using primers oAA2070 and oAA2075. The second DNA fragment (PURA3URA3TURA3PURA3) was amplified from plasmid pAA298 using primers oAA2072 and oAA2073. The third DNA fragment (FAT1 3' homology) was amplified from plasmid pAA296 using primers oAA2074 and oAA2075. All three DNA fragments were combined in the same reaction to create a full-length deletion cassette by OE-PCR using primers oAA2070 and oAA2071. Strain sAA869 was transformed with the full-length deletion cassette and plated on SCD-Ura plate. Several colonies were screened by PCR for integration of the deletion cassette at the second FAT1 allele. One such strain was named sAA875. *Candida* strain sAA875 was grown overnight in YPD media and then streaked on to in5-fluorotic acid containing plates. Single colonies were tested for URA3 reversion frequency, and the isolate with least reversion frequency was named sAA886.

A disruption cassette for the first allele of the POX5 gene was constructed by overlapping PCR. A 5' POX5 (+34 to +488 of the ORF) or 3' POX5 (+1487 to +1960 of the OrF) fragment was PCR amplified using genomic DNA from ATCC20336 as the template and primers oAA2173 and oAA2174 (for the 5' fragment) or oAA2177 and oAA2178 (for the 3' fragment). A *Candida* URA3 gene fragment with direct repeat was PCR amplified using oAA2175 and oAA2176 as primers. The three gene fragments were then gel purified, combined, ligated and used as template for to make the full length construct via PCR using oAA2173 and oAA2178 as primers. This approximately 2.9 Kb fragment was gel purified and used to transform sAA886. Transformants were selected by growth in ScD-ura plates. Colonies were re-streaked to isolate individual transformants. Disruption of the first allele of POX5 was verified by PCR. A strain with the right genotype was named sAA940.

Strain sAA940 was grown overnight in YPD and then streaked in 5-fluorotic acid containing plates. Strains were screened by PCR for the present of the POX5 deletion. A strain with the right genotype was renamed sAA969.

A disruption cassette for the second allele of the POX5 gene was constructed by overlapping PCR. A 5' POX5 (+489 to +960 of the ORF) or 3' POX5 (+1014 to +1479 of the ORF) fragment was PCR amplified using genomic DNA from ATCC20336 and primers oAA2188 and oAA2189 or oAA2192 and oAA2193, respectively. A *Candida* URA3 gene fragment with the terminator as a direct repeat was PCR amplified using oAA2190 and oAA2191 as primers and pAA298 as template. These three DNA fragments were gel purified, combined, ligated and used as template for PCR using oAA2188 and oAA2193 as primers. This approximately 2.9 Kb fragment was gel purified and used to transform strain sAA969. Transformants were selected by growth in ScD-ura plates. Colonies were re-streaked to isolate individual transformants. Strains were screened for disruption of both POX5 alleles by PCR. A strain with the right genotype was named sAA988.

Example 46: Construction of a POX4, POX5, ACS1 Deletion Strain

A disruption cassette for the first ACS1 gene allele was constructed by overlapping PCR. A 5' ACS1 (+101 to +601 of the ORF) or 3' ACS1 fragment (+1546 to +1960 of the ORF) was PCR amplified using genomic DNA from ATCC20962 and primers oAA2406 and oAA2407 or oAA2408 and oAA2409, respectively. A *Candida* URA3 gene fragment was PCR amplified using oAA2410 and oAA2411 as primers and pAA244 (described in Example 58) as template. The three gene fragments were gel purified, combined, ligated and used as template for PCR using oAA2406 and oAA2409 as primers. This PCR fragment was gel purified and used to transform sAA103. Transformants were selected by growth in ScD-ura plates. Colonies were re-streaked to isolate individual transformants. Disruption of the first allele of ACS1 was verified by PCR. A strain with the right genotype was named sAA1185.

sAA1185 was grown overnight in YPD and streaked in streaked in 5-fluoorotic acid containing plates. Strains were screened by PCR for the present of the ACS1 deletion. A strain with the right genotype was renamed sAA1313.

A nested disruption cassette was constructed by overlapping PCR. A 5' ACS1 (+626 to +1021 of the ORF) or a 3' ACS1 (+1151 to +1518 of the ORF) fragment was PCR amplified using genomic DNA from ATCC20336 and primers oAA2412 and oAA2413 or oAA2414 and oAA2415, respectively. A *Candida* URA3 fragment was PCR amplified using oAA2416 and oAA2417 as primers for amplification of the URA3 gene. The three fragments were gel purified, combined and used as template for PCR with oAA2412 and oAA2415 as primers for this PCR reaction. The correct PCR fragment was gel purified and used to transform sAA1184. Transformants were selected by growth in ScD-ura plates. Colonies were re-streaked to isolate individual transformants. These transformants were screened for disruption of both ACS1 alleles by PCR. A strain with the correct genotype was named sAA1371.

Example 47: Construction and Evaluation of Certain CPR750-CYP450 Strains

Plasmids comprising a combination the CPR750 gene and one or more CYP450 genes were created ligating either the CPR750 gene containing the endogenous CPR750 promoter (see plasmid pAA067 in Example 16) into each of pAA151-158, pAA160 or pAA161 as follows (TABLE 23).

Plasmid pAA151 was digested with Sbf1/SpeI restriction enzymes and the 2584 bp fragment encoding CPR750 was isolated and ligated into the 6198 bp fragment of pAA067 when digested with Sbf1 and Spe1. The ligation mixture was transformed into *E. coli* cells (DH5alpha). Plasmids were verified by restriction enzyme analysis and sequencing. A plasmid with the correct sequence was named pAA223.

TABLE 23

| Final Plasmid | P450 | | | | CPR750 | | |
|---|---|---|---|---|---|---|---|
| | P450 | Plasmid | Enzymes | Fragment size | Plasmid | Enzymes | Fragment size |
| pAA223 | A12 | pAA151 | Sbf1/SpeI | 2584 | pAA067 | Sbf1/SpeI | 6198 |
| pAA224 | A13 | pAA152 | Sbf1/SpeI | 2609 | pAA067 | Sbf1/SpeI | 6198 |
| pAA225 | A14 | pAA153 | Sbf1/SpeI | 2581 | pAA067 | Sbf1/SpeI | 6198 |
| pAA226 | A15 | pAA160 | SbfI/PciI | 5712 | pAA067 | SbfI/PciI/ApaL1 | 3121 |
| pAA227 | A16 | pAA161 | SbfI/PciI | 5712 | pAA067 | SbfI/PciI | 3121 |
| pAA228 | A17 | pAA154 | Sbf1/SpeI | 2594 | pAA067 | Sbf1/SpeI | 6198 |
| pAA229 | A18 | pAA155 | Sbf1/SpeI | 2566 | pAA067 | Sbf1/SpeI | 6198 |
| pAA230 | A19 | pAA156 | Sbf1/SpeI | 2551 | pAA067 | Sbf1/SpeI | 6198 |
| pAA231 | A20 | pAA157 | Sbf1/SpeI | 2551 | pAA067 | Sbf1/SpeI | 6198 |
| pAA232 | D2 | pAA148 | Sbf1/SpeI | 3512 | pAA067 | Sbf1/SpeI | 6198 |

Plasmids pAA223 and pAA233 were linearized with SpeI (New England Biolabs) while the remaining plasmids were linearized with ClaI (New England Biolabs). sAA103 was transformed with the linearized plasmids. Transformants were selected by growth in ScD-ura plates. Colonies were streaked for single isolates and transformants in each isolate were selected and verified by PCR.

The strains prepared above were then tested for production of di-acids using coconut oil as a substrate ("feedstock").

Strains were grown overnight in SP92+glycerol (5 mL), then transferred to 50 mL SP92+glycerol (50 mL) at a starting OD=0.4. Each strain was centrifuged and the pellet resuspended in TB lowN medium (12.5 mL). To each flask 2% coconut oil was added. Flasks were incubated at 300 RPMs 30° C. Samples (1 mL) were taken at 30 and 96 hrs. for GC analysis.

As can be seen in TABLE 24, P450 A19 showed the biggest improvement in diacid formation on C10, C12 and C14 fatty acids.

TABLE 24

| | Gene | Diacid formed from total acid at 30 hrs. | | | | |
|---|---|---|---|---|---|---|
| Strain | P450 | C6 | C8 | C10 | C12 | C14 |
| sAA003 | N/A | 0.24 | 0.03 | 0.61 | 0.40 | 0.16 |
| sAA0797 | P450 A12 | 0.21 | 0.04 | 0.31 | 0.11 | 0.04 |
| sAA0798 | P450 A13 | 0.15 | 0.03 | 0.71 | 0.71 | 0.35 |

TABLE 24-continued

| Strain | Gene P450 | Diacid formed from total acid at 30 hrs. | | | | |
|---|---|---|---|---|---|---|
| | | C6 | C8 | C10 | C12 | C14 |
| sAA0799 | P450 A14 | 0.18 | 0.03 | 0.29 | 0.08 | 0.03 |
| sAA0800 | P450 A15 | 0.13 | 0.04 | 0.60 | 0.35 | 0.14 |
| sAA0801 | P450 A15 | 0.16 | 0.06 | 0.75 | 0.65 | 0.33 |
| sAA0802 | P450 A15 | 0.20 | 0.08 | 0.75 | 0.67 | 0.38 |
| sAA0803 | P450 A16 | 0.20 | 0.03 | 0.67 | 0.46 | 0.19 |
| sAA0804 | P450 A17 | 0.26 | 0.07 | 0.74 | 0.64 | 0.41 |
| sAA0805 | P450 A18 | 0.19 | 0.08 | 0.81 | 0.81 | 0.55 |
| sAA0806 | P450 A19 | 0.24 | 0.56 | 0.95 | 0.92 | 0.73 |
| sAA0807 | P450 A20 | 0.22 | 0.38 | 0.83 | 0.64 | 0.32 |

Example 48: Conversion of Methyl Laurate and Methyl Myristate to the Corresponding Diacid—Comparison of Strain sAA1304 to sAA003

A pre-culture of 80 mL SP92 (6.7 g/L yeast nitrogen base, 3.0 g/L yeast extract, 3.0 g/L $(NH_4)_2SO_4$, 1.0 g/L $K_2HPO_4$, 1.0 g/L $KH_2PO_4$, 75 g/L dextrose) in a 500 mL baffled flask with foam plugs was inoculated with 1.0 mL from a frozen glycerol stock of strain sAA003 (beta-oxidation blocked strain) or strain sAA1304 (beta-oxidation blocked strain plus amplified CPRB and CYP52A19) and incubated for 24 h at 30° C. and 250 RPM. Fermentation medium (MM1) of composition 27 g/L dextrose, 7.0 g/L ammonium sulfate, 5.1 g/L potassium phosphate monobasic, 1.024 g/L magnesium sulfate heptahydrate, 0.155 g/L calcium sulfate dihydrate, 0.06 g/L citric acid anhydrous, 0.04 g/L ferrous sulfate heptahydrate, 0.0002 mg/L biotin, 1.0 mL trace minerals solution (0.9 g/L boric acid, 0.11 g/L cupric sulfate pentahydrate, 0.18 g/L potassium iodide, 0.806 g/L manganese sulfate monohydrate, 0.360 g/L sodium molybdate, 0.720 g/L zinc sulfate), pH 5.8 was filter sterilized and transferred to a sterile fermentation vessel. Growth was initiated with an inoculum of pre-culture to an initial $OD_{600\ nm}=1.0$ and growth conditions of 35° C., 1000 rpm, 1 vvm, pH 5.8. Growth continued for approximately 10-12 h at which point the conversion phase was initiated by the addition of a bolus of 5 g/L of feedstock (methyl myristate only), followed immediately by a continuous feed of feedstock. Because of the toxicity of lauric acid, which is formed during the conversion process by demethylation of methyl laurate at high concentrations, no initial bolus was given. Feedstock feed rates varied as follows: methyl myristate (Sigma-Aldrich #W272205), 1.0 g/L-h for the first 24 h; 1.5 g/L-h from 24 h to termination; methyl laurate (Sigma-Aldrich #W271500), 0.5 g/L-h for the first 24 h; 1.2 g/L-h from 24 h to termination. In addition, a co-feed of glucose was fed at a rate of 1.25 g/L-h when using methyl myristate as substrate or at a rate of 1.0 g/L-h when using methyl laurate as substrate. At induction, the temperature was changed to 30° C. and the pH was maintained at 6.0 by addition of 6N KOH. The data in FIG. 20 shows the production of either dodecanedioic acid from methyl laurate or tetradecanedioic acid from methyl myristate and demonstrates the improved productivity of strain sAA1306 over sAA003 on both feedstocks. When methyl myristate was used as feedstock, sAA1306 showed an approximately 25% improvement in productivity over sAA003.

Example 49: Conversion of Methyl Laurate and Methyl Myristate to the Corresponding Diacid—Comparison of Strain sAA1082 to sAA003

A pre-culture of 80 mL SP92 in a 500 mL baffled flask with foam plugs was inoculated with 1.0 mL from a frozen glycerol stock of strain sAA003 (beta-oxidation blocked strain) or strain sAA1082 (beta-oxidation blocked strain plus amplified CPRB and CYP52A19) and incubated for 24 h at 30° C. and 250 RPM. Fermentation medium (MM1) at pH 5.8 was filter sterilized and transferred to a sterile fermentation vessel. Growth was initiated with an inoculum of pre-culture to an initial $OD_{600\ nm}=1.0$ and growth conditions of 35° C., 1000 rpm, 1 vvm, pH 5.8. Growth continued for approximately 10-12 h at which point the conversion phase was initiated by the addition of a bolus of 5 g/L of feedstock (methyl myristate only), followed immediately by a continuous feed of feedstock. Because of the toxicity of lauric acid, which is formed during the conversion process by demethylation of methyl laurate at high concentrations, no initial bolus was given. Feedstock feed rates varied as follows: methyl myristate, 1.0 g/L-h for the first 24 h; 1.5 g/L-h from 24 h to termination; methyl laurate, 0.75 g/L-h for the first 24 h; 1.4 g/L-h from 24 h to termination. In addition, a co-feed of glucose was fed at a rate of 1.25 g/L-h for all fermentations. At induction, the temperature was changed to 30° C. and the pH was maintained at 6.0 by addition of 6N KOH. The data in FIG. 21 show the production of either dodecanedioic acid from methyl laurate or tetradecanedioic acid from methyl myristate and demonstrate improved productivity of strain sAA1082 over sAA003 on both feedstocks. When methyl laurate was used as feedstock, sAA1082 demonstrated about 23% productivity improvement over sAA003. With methyl myristate as feedstock, sAA1082 showed an approximately 37% improvement over sAA003.

Example 50: Conversion of Oleic to Cis-9-Octadecenedioic Acid—Comparison of Strains sAA1233, sAA1306 and sAA1485 to sAA003

A pre-culture of 80 mL SP92 in a 500 mL baffled flask with foam plugs was inoculated with 1.0 mL from a frozen glycerol stock of strain sAA003 (beta-oxidation blocked strain), strain sAA1233 (beta-oxidation blocked strain plus amplified ZWF1), strain sAA1306 (beta-oxidation blocked strain plus amplified IDP2), or strain sAA1485 (beta-oxidation blocked strain plus amplified KlGDP1) and incubated for 24 h at 30° C. and 250 RPM. Fermentation medium (MM1) at pH 5.8 was filter sterilized and transferred to a sterile fermentation vessel. Growth was initiated with an inoculum of pre-culture to an initial $OD_{600\ nm}=1.0$ and growth conditions of 35° C., 1000 rpm, 1 vvm, pH 5.8. Growth continued for approximately 10-12 h at which point the conversion phase was initiated by the addition of a bolus of 5 g/L of oleic acid (Sigma-Aldrich #W281506), followed immediately by a continuous feed of feedstock at a rate of 2.0 g/L-h throughout the conversion phase. In addition, a co-feed of glucose was fed at a rate of 1.25 g/L-h for all fermentations. At induction, the temperature was changed to 30° C. and the pH was maintained at 6.0 by addition of 6N KOH. The data in FIG. 22 are averages of three identical fermentations and show the production cis-9-octadecenedioic acid (C18:1 diacid) from oleic acid.

All three amplified genes (ZWF1, IDP2, and KlGDP1) code for enzymes that produce NADPH during the biochemical reaction and, because of that, increased expression of those enzymes should result in increased intracellular levels of NADPH. Omega-hydroxy fatty acids (HFAs) are observed to be produced as a result of incomplete oxidation of the fatty acid feedstock to the corresponding diacid. One reason for this incomplete oxidation may be reduced levels of NADPH, which is required for the over-oxidation reaction of HFAs by cytochrome P450 Thus, increasing the intracellular pool of NADPH should result in decreased levels of HFA in the fermentation broth. The concentrations of HFAs produced during the omega oxidation of oleic acid by strains sAA003, sAA1233, sAA1306 and sAA1485 are shown in FIG. 23. The results (averages of three fermentations) demonstrate that all three test strains (sAA1233, sAA1306 and sAA1485) produced lower levels of HFAs than the base strain, sAA003. Production of HFAs in a commercial diacid fermentation process is undesirable, since it results in lower molar yields and has to be removed during purification of the diacid. These results indicate that amplification of either ZWF1, IDP2 or KlGDP1 should result in an improved diacid fermentation having lower levels of HFAs.

Example 51: Conversion of Methyl Decanoate to Sebacic Acid—Comparison of Strain sAA1082 to sAA003

Omega-oxidation of decanoic acid to produce sebacic acid by a *Candida* strain can be impractical due to the high degree of toxicity of this potential feedstock (ref). An alternative is to use methyl decanoate, which has very low toxicity. Methyl esters of fatty acids can be converted to the corresponding diacid by beta-oxidation-blocked strains of *Candida* since *Candida* produces an esterase that demethylates the fatty acid ester during the omega-oxidation process, allowing conversion of methyl decanoate into the non-toxic diacid, sebacic acid. Unfortunately, having an excess of methyl decanoate in the fermentation broth prior to induction of the enzymes involved in omega-oxidation process results in sufficient demethylation of methyl decanoate to produce toxic levels of decanoic acid, resulting in rapid cell death and a failed fermentation. The standard fermentation procedure would utilize the feedstock (methyl decanoate) as inducer. However, an alternative would be to induce with a non-toxic inducer, such as decane, which has the same carbon chain-length as decanoic acid, but which does not produce decanoic acid during bioconversion to sebacic acid. A set of four fermentations was performed to compare decane to methyl decanoate as inducer as well as to compare the beta-oxidation blocked base strain, sAA003 to strain sAA1082, which has amplified CPRB and CYP52A19 genes. In a previous example, sAA1082 demonstrated increased productivity over sAA003 with both methyl laurate and methyl myristate.

A pre-culture of 80 mL SP92 in a 500 mL baffled flask with foam plugs was inoculated with 1.0 mL from a frozen glycerol stock of strain sAA003 (beta-oxidation blocked strain) or strain sAA1082 (beta-oxidation blocked strain plus amplified CPRB and CYP52A19) and incubated for 24 h at 30° C. and 250 RPM. Fermentation medium (MM1) at pH 5.8 was filter sterilized and transferred to a sterile fermentation vessel. Growth was initiated with an inoculum of pre-culture to an initial $OD_{600\ nm}=1.0$ and growth conditions of 35° C., 1000 rpm, 1 vvm, pH 5.8. Growth continued for approximately 10-12 h at which point the conversion phase was induced by the addition of either: 1) a bolus of 10 g/L of decane (Sigma-Aldrich #457116) for 6 h after which a continuous feed of methyl decanoate (TCI America #D0023) at 0.25 g/L-h was initiated or 2) no addition of decane. Induction was performed by initiating a continuous feed of methyl decanoate at 0.25 g/L-h. Because of the volatility of decane, the aeration rate was reduced to 0.3 vvm during the 6-h induction phase with decane as inducer. In addition, a co-feed of glucose was fed at a rate of 1.25 g/L-h for all fermentations. At induction, the temperature was changed to 30° C. and the pH was maintained at 6.0 by addition of 6N KOH. The data in FIG. 24 show the production of decanedioic acid (sebacic acid) and compare the productivity of the two strains under the two different induction conditions. When induced only with methyl decanoate, neither strain sAA003 nor sAA1082 produced significant quantities of sebacic acid over the course of the fermentation. However, both strains produced sebacic acid when induced with decane prior to beginning a slow feed of methyl decanoate. Strain sAA1082, however, yielded an over four times higher titer of sebacic acid at 84 h fermentation time than strain sAA003, indicating that sAA1082 is a superior strain for diacid production on methyl decanoate as well as methyl laurate and methyl myristate as feedstock. One of the reasons why productivity was better with strain sAA1082 induced with decane is illustrated in FIG. 25, which shows the amount of decanoic acid produced under the different fermentation conditions. The only fermentation that did not produce a detectable quantity of the toxic by-product, decanoic acid, was the fermentation with strain sAA1082 induced with decane. The other three fermentations produced between 1 and 4 g/L decanoic acid. Viable cell count data demonstrates the toxicity of decanoic acid. The only fermentation where viable cell counts remained high throughout the fermentation was the fermentation with strain sAA1082 induced with decane. The other three fermentations lost between $10^3$-$10^5$ viable cells/mL of culture broth. That significant reduction of biologically-active cells resulted in a large accumulation of both methyl decanoate and dextrose in all fermentations except the fermentation with sAA1082 induced with decane. That fermentation showed little to no accumulation of either methyl decanoate or dextrose. These data indicate that it would probably have been possible to use a higher methyl decanoate feed rate than 0.25 g/L-h. These results demonstrate that under the right induction conditions and with an improved production strain, it is possible to produce significant quantities of sebacic acid from the methyl ester of a toxic fatty acid.

Other non-toxic inducers, such as alkanes with chain lengths greater than C6, fatty acids with chain-lengths greater than C12, various esters of fatty acids greater than C12, triglycerides containing various chain-length fatty acids, or other non-toxic chemicals containing a long aliphatic chain greater than C6 could be used as a non-toxic inducer. However, as in this example, using an inducer that would not produce sebacic acid during the omega-oxidation process, would likely result in an oxidation product that would need to be purified from the desired product, sebacic acid.

The method described in this example—for employing a non-toxic feedstock to induce diacid production from the methyl ester of a toxic fatty acid—could be used with fermentations utilizing methyl laurate as feedstock. Lauric acid is not as toxic to *Candida* as is decanoic acid, but care must be exercised in the induction process to feed methyl laurate at a rate sufficient to allow good induction without overfeeding, which would result in the production and accumulation of toxic levels of lauric acid due to demethylation by esterases.

Example 52: Conversion of Methyl Laurate to DDDA—Comparison of Strain sAA1569 to sAA003

A pre-culture of 80 mL SP92 in a 500 mL baffled flask with foam plugs was inoculated with 1.0 mL from a frozen glycerol stock of strain sAA003 (beta-oxidation blocked strain), or strain sAA1569 (beta-oxidation blocked strain plus amplified CPRB and CYP52A14), and incubated for 24 h at 30° C. and 250 RPM. Fermentation medium (MM1) at pH 5.8 was filter sterilized and transferred to a sterile fermentation vessel. Growth was initiated with an inoculum of pre-culture to an initial $OD_{600\ nm}$=1.0 and growth conditions of 35° C., 1000 rpm, 1 vvm, pH 5.8. Growth continued for approximately 10-12 h at which point the conversion phase was initiated by a continuous feed of methyl laurate at a rate of 0.75 g/L-h for the first 24 h; 1.5 g/L-h from 24 h to termination. In addition, a co-feed of glucose was fed at a rate of 1.25 g/L-h for all fermentations. At induction, the temperature was changed to 30° C. and the pH was maintained at 6.0 by addition of 6N KOH. The data in FIG. 26 are averages of two identical fermentations and show the production of DDDA and 12-hydroxy-dodecanoic acid (HFA) from methyl laurate. Although strain sAA1569 did not exhibit increased productivity over sAA003, it did produce less than half the amount of HFA as sAA003. This result is likely due to CYP52A14 exhibiting a greater rate of over-oxidation of omega-hydroxy dodecanoic acid than the native P450s.

Example 53: Conversion of Methyl Laurate to DDDA—Comparison of Strains sAA1082 and sAA1633 to sAA003

A pre-culture of 80 mL SP92 in a 500 mL baffled flask with foam plugs was inoculated with 1.0 mL from a frozen glycerol stock of strain sAA003 (beta-oxidation blocked strain), strain sAA1082 (beta-oxidation blocked strain plus amplified CPRB and CYP52A19) or sAA1633 (beta-oxidation blocked strain plus amplified CPRB, CYP52A19 and ZWF1), and incubated for 24 h at 30° C. and 250 RPM. Fermentation medium (MM1) at pH 5.8 was filter sterilized and transferred to a sterile fermentation vessel. Growth was initiated with an inoculum of pre-culture to an initial $OD_{600\ nm}$=1.0 and growth conditions of 35° C., 1000 rpm, 1 vvm, pH 5.8. Growth continued for approximately 10-12 h at which point the conversion phase was initiated by a continuous feed of methyl laurate at a rate of 0.75 g/L-h for the first 24 h; 1.5 g/L-h from 24 h to termination. In addition, a co-feed of glucose was fed at a rate of 1.25 g/L-h for all fermentations. At induction, the temperature was changed to 30° C. and the pH was maintained at 6.0 by addition of 6N KOH. The data in FIG. 27 are averages of two identical fermentations and show the production of DDDA from methyl laurate. Strain sAA1082 again demonstrated about 23% increase in productivity over sAA003. Strain sAA1633 exhibited an even greater productivity increase of about 30% over sAA003. This additional productivity increase was probably due to the amplification of ZWF1, leading to increased production of NADPH, which provides electrons for the omega-oxidation pathway.

Example 54: Conversion of methyl laurate to DDDA—comparison of strains sAA1901, sAA1904, sAA1803 and sAA1805 to sAA003

A pre-culture of 80 mL SP92 in a 500 mL baffled flask with foam plugs was inoculated with 1.0 mL from a frozen glycerol stock of strain sAA003 (beta-oxidation blocked strain), sAA1901 (beta-oxidation blocked strain plus amplified ADH3), sAA1904 (beta-oxidation blocked strain plus amplified ADH8), strain sAA1803 (beta-oxidation blocked strain plus amplified ADH2a) or sAA1805 (beta-oxidation blocked strain plus amplified ADH2b), and incubated for 24 h at 30° C. and 250 RPM. Fermentation medium (MM1) at pH 5.8 was filter sterilized and transferred to a

TABLE 25

Supplemental List I of Oligonucleotides used in Examples 1-56
(SEQ ID NOS 253-286, respectively, in order of appearance)

| | |
|---|---|
| oAA3022 | CACACAGCTCTTCCATAATGACTGTTGACGCTTCTTC |
| oAA3023 | CACACAGCTCTTCCCTCTCTTCTATTCCTAATTGCCAAAAGCTTTGT |
| oAA3024 | CACACAGCTCTTCCATAATGTCACTTGTCCTCAAGCG |
| oAA3025 | CACACAGCTCTTCCCTCTCTTCTATTCTTATGGGTGGAAGACAACTC |
| oAA3026 | CACACAGCTCTTCCATAATGTCAACTCAATCAGGTTA |
| oAA3027 | CACACAGCTCTTCCCTCTCTTCTATTCCTACAACTTACTTGGTCTAA |
| oAA3028 | CACACAGCTCTTCCATAATGTCATTATCAGGAAAGAC |
| oAA3029 | CACACAGCTCTTCCCTCTCTTCTATTCTTAACGAGCAGTGAAACCAC |
| oAA3030 | CACACAGCTCTTCCATAATGAGTAAGTCATACAAGTT |
| oAA3031 | CACACAGCTCTTCCCTCTCTTCTATTCCTACAAAGAGGCACCAATAAA |
| oAA3032 | CACACAGCTCTTCCATAATGTCCCACCATCTAAATT |
| oAA3033 | CACACAGCTCTTCCCTCTCTTCTATTCTCTATTGCTTATTAGTGATG |
| oAA3035 | CACACAGCTCTTCCCTCTCTTCTATTCTCACCACATGTTGACAACAG |
| oAA3036 | CACACAGCTCTTCCATAatgtctgaatcaaccgttggaaaaccaatcacctgtaaagccg |
| oAA3054 | CACACAGCTCTTCCATAATGTCTGCTAATATCCCAAAAACTCAAAAAG |
| oAA3073 | gttaggcttcaacgctattcaaatattgaaaagctacaattgttacattg |

TABLE 25-continued

Supplemental List I of Oligonucleotides used in Examples 1-56
(SEQ ID NOS 253-286, respectively, in order of appearance)

| | |
|---|---|
| oAA3074 | caatgtaacaattgtagcttttcaatatttgaatagcgttgaagcctaac |
| oAA3120 | CACACAGCTCTTCCATAATGTCCGTTCCAACTACTCA |
| oAA3121 | CACACAGCTCTTCCCTCTCTTCTATTCCTACTTTGACGTATCAACGA |
| oAA1023 | GATATTATTCCACCTTCCCTTCATT |
| oAA1024 | CCGTTAAACAAAAATCAGTCTGTAAA |
| oBS1 | GGTTTCATAAGCCTTTTCACGGTCTTC |
| oBS2 | GAGTTGACAAAGTTCAAGTTTGCTGTC |
| oJRH4 | AGTCAGTACTCGAGTTAAACACCAGCTTCGAAGTCC |

TABLE 26

Supplemental List II of Oligonucleotides used in Examples 1-56
(SEQ ID NOS 287-315, respectively, in order of appearance)

| Oligo Designation | Nucleotide sequence (optional) |
|---|---|
| oAA2068 | TCCTCGTCCATCTTCAACAAGTCGGTACCGAGCTCTGCGAATT |
| oAA2069 | AATTCGCAGAGCTCGGTACCGACTTGTTGAAGATGGACGAGGA |
| oAA2070 | TTGATCCACTGTCTTAAGATTGTCAA |
| oAA2071 | CCGAAACAACCGTAGATACCTTTAACCAGAACGAAGTAGCGGAGAAT |
| oAA2072 | ATTCTCCGCTACTTCGTTCTGGTTAAAGGTATCTACGGTTGTTTCGG |
| oAA2073 | CGACAGACCTCACCGACGTATGGTACCGAGCTCTGCGAATT |
| oAA2074 | AATTCGCAGAGCTCGGTACCATACGTCGGTGAGGTCTGTCG |
| oAA2075 | AGGATTTTGCTGTTGGTGGC |
| oAA2127 | CACACAGCTCTTCCATAATGGTCGCCGATTCTTTAGT |
| oAA2128 | CACACAGCTCTTCCCTCTCTTCTATTCTTAAGTGGCCTTCCACAAGT |
| oAA2173 | ACCAAGTTCAACCCAAAGGAGT |
| oAA2174 | CCGAAACAACCGTAGATACCTTTAATCTTCGTCAAAAGTGGCGGT |
| oAA2175 | ACCGCCACTTTTGACGAAGATTAAAGGTATCTACGGTTGTTTCGG |
| oAA2176 | AATGTCGAAACCCTTGTCTTCAGGGTACCGAGCTCTGCGAATT |
| oAA2177 | AATTCGCAGAGCTCGGTACCCTGAAGACAAGGGTTTCGACATT |
| oAA2178 | CGGACTTTTCACCTCTTTCTCTG |
| oAA2188 | CACTGACGAGTTTGTCATCAACAC |
| oAA2189 | CCGAAACAACCGTAGATACCTTTAAGGTATCGGTGTCCTTCTTCTTGA |
| oAA2190 | TCAAGAAGAAGGACACCGATACCTTAAAGGTATCTACGGTTGTTTCGG |
| oAA2191 | ACAAGTAAGCGGCAGCCAAGGGTACCGAGCTCTGCGAATT |
| oAA2192 | AATTCGCAGAGCTCGGTACCCTTGGCTGCCGCTTACTTGT |
| oAA2193 | ACCAATGTCTCTGGCCAAGC |
| oAA2206 | TTCCGCTTAATGGAGTCCAAA |
| oAA2209 | TAAACGTTGGGCAACCTTGG |
| oAA2406 | CAGACTCAAAGGCAACCACTT |

TABLE 26-continued

Supplemental List II of Oligonucleotides used in Examples 1-56
(SEQ ID NOS 287-315, respectively, in order of appearance)

| Oligo Designation | Nucleotide sequence (optional) |
|---|---|
| oAA2407 | tttattggagctccaattgtaatatttcggGATGACATACTTGACGGAGGTG |
| oAA2408 | aaacaaccataaagctgcttgacaaAGAACGAAGAAGAAACCAAGGC |
| oAA2409 | GCAACAATTCAATACCTTTCAAACC |
| oAA2410 | CACCTCCGTCAAGTATGTCATCccgaaatattacaattggagctccaataaa |

TABLE 27

Supplemental List III of Oligonucleotides used in Examples 1-56
(SEQ ID NOS 316-358, respectively, in order of appearance)

| Oligo Designation | Nucleotide sequence (optional) |
|---|---|
| oAA2411 | GCCTTGGTTTCTTCTTCGTTCTttgtcaagcagctttatggttgttt |
| oAA2412 | ACAAGAGACAGGGCGGCAAA |
| oAA2413 | tttattggagctccaattgtaatatttcggCGGTCAAAGTCTTGACATTGG |
| oAA2414 | aaacaaccataaagctgcttgacaaACAAAAGATCTTCTGGGCTGC |
| oAA2415 | TTTCAACCAGATTTCACCCTG |
| oAA2416 | CCAATGTCAAGACTTTGACCGccgaaatattacaattggagctccaataaa |
| oAA2417 | GCAGCCCAGAAGATCTTTTGTttgtcaagcagctttatggttgttt |
| oAA2804 | gatttacaccgcgggtaccaccggtttgcc |
| oAA2805 | GGCAAACCGGTGGTACCCGCGGTGTAAATC |
| oAA2839 | CACACAGCTCTTCCATAATGTCAGGATTAGAAATAGCCGCTG |
| oAA2854 | CACACAGCTCTTCCATAATGCCCGATATGACAAACGAAT |
| oAA2855 | CACACAGCTCTTCCCTCTCTTCTATTCAACACCAGCTTCGAAGTCCTTT |
| oAA2875 | CACACAGCTCTTCCCTCTCTTCTATTCCTACAATTTGGCTTTACCGGTACAAA |
| oAA3016 | CACACAGCTCTTCCATAATGCATGCATTATTCTCAAAATC |
| oAA3017 | CACACAGCTCTTCCCTCTCTTCTATTCTCATTTGGAGGTATCCAAGA |
| oAA3018 | CACACAGCTCTTCCATAATGTCAATTCCAACTACTCA |
| oAA3019 | CACACAGCTCTTCCCTCTCTTCTATTCTTACTTAGAGTTGTCCAAGA |
| oAA3020 | CACACAGCTCTTCCATAATGTCAATTCCAACTACCCA |
| oAA3021 | CACACAGCTCTTCCCTCTCTTCTATTCCTACTTGGCAGTGTCAACAA |
| oAA3022 | CACACAGCTCTTCCATAATGACTGTTGACGCTTCTTC |
| oAA3023 | CACACAGCTCTTCCCTCTCTTCTATTCCTAATTGCCAAAAGCTTTGT |
| oAA3024 | CACACAGCTCTTCCATAATGTCACTTGTCCTCAAGCG |
| oAA3025 | CACACAGCTCTTCCCTCTCTTCTATTCTTATGGGTGGAAGACAACTC |
| oAA3026 | CACACAGCTCTTCCATAATGTCAACTCAATCAGGTTA |
| oAA3027 | CACACAGCTCTTCCCTCTCTTCTATTCCTACAACTTACTTGGTCTAA |
| oAA3028 | CACACAGCTCTTCCATAATGTCATTATCAGGAAAGAC |
| oAA3029 | CACACAGCTCTTCCCTCTCTTCTATTCTTAACGAGCAGTGAAACCAC |
| oAA3030 | CACACAGCTCTTCCATAATGAGTAAGTCATACAAGTT |

TABLE 27-continued

Supplemental List III of Oligonucleotides used in Examples 1-56
(SEQ ID NOS 316-358, respectively, in order of appearance)

| Oligo Designation | Nucleotide sequence (optional) |
|---|---|
| oAA3031 | CACACAGCTCTTCCCTCTCTTCTATTCCTACAAAGAGGCACCAATAAA |
| oAA3032 | CACACAGCTCTTCCATAATGTCCCCACCATCTAAATT |
| oAA3033 | CACACAGCTCTTCCCTCTCTTCTATTCTCTATTGCTTATTAGTGATG |
| oAA3035 | CACACAGCTCTTCCCTCTCTTCTATTCTCACCACATGTTGACAACAG |
| oAA3036 | CACACAGCTCTTCCATAatgtctgaatcaaccgttggaaaaccaatcacctgtaaagccg |
| oAA3054 | CACACAGCTCTTCCATAATGTCTGCTAATATCCCAAAAACTCAAAAAG |
| oAA3073 | gttaggcttcaacgctattcaaatattgaaaagctacaattgttacattg |
| oAA3074 | caatgtaacaattgtagcttttcaatatttgaatagcgttgaagcctaac |
| oAA3120 | CACACAGCTCTTCCATAATGTCCGTTCCAACTACTCA |
| oAA3121 | CACACAGCTCTTCCCTCTCTTCTATTCCTACTTTGACGTATCAACGA |
| oAA1023 | GATATTATTCCACCTTCCCTTCATT |
| oAA1024 | CCGTTAAACAAAAATCAGTCTGTAAA |
| oBS1 | GGTTTCATAAGCCTTTCACGGTCTTC |
| oBS2 | GAGTTGACAAAGTTCAAGTTTGCTGTC |
| OJRH4 | AGTCAGTACTCGAGTTAAACACCAGCTTCGAAGTCC |

TABLE 28

Supplemental list of genes and the names of the oligonucleotides used to clone or subclone them.

| Gene | Primer 1 | Primer 2 |
|---|---|---|
| ADH1-1-short | oAA3054 | oAA3017 |
| ADH1-2 | oAA3016 | oAA3017 |
| ADH1-2-short | oAA3054 | oAA3017 |
| ADH2A | oAA3018 | oAA3019 |
| ADH2B | oAA3020 | oAA3021 |
| ADH7 | oAA3022 | oAA3023 |
| ADH5 | oAA3024 | oAA3025 |
| ADH3 | oAA3026 | oAA3027 |
| ADH4 | oAA3028 | oAA3029 |
| SFA1 | oAA3036 | oAA3035 |
| ADH8 | oAA3120 | oAA3121 |
| ZWF1 | oAA831 | oAA832 |
| FAT1 | oAA2839 | oAA2875 |
| FAO1ΔPTS1 | oAA3068 | oAA3069 |
| PEX11 | oAA2127 | oAA2128 |
| HFD1 | oAA3030 | oAA3031 |
| HFD2 | oAA3032 | oAA3033 |
| CPRB | oAA694 | oAA695 |
| P450 A12 | oAA515 | oAA516 |
| P450 A13 | oAA517 | oAA518 |
| P450 A14 | oAA519 | oAA520 |
| P450 A15 | oAA509 | oAA510 |
| P450 A16 | oAA511 | oAA512 |
| P450 A17 | oAA521 | oAA522 |
| P450 A18 | oAA523 | oAA524 |
| P450 A19 | oAA525 | oAA526 |
| P450 A20 | oAA527 | oAA528 |
| P450 D2 | oAA529 | oAA530 |
| IDP2 | oAA2053 | oAA2054 |
| KlGDP1* | oAA2854 | oAA2855 |

Example 55: Replacement of the FAO1 Promoter with a Stronger or Constitutive Promoter The following Promoter Replacement DNA I molecule is constructed by either overlapping PCR, DNA synthesis or a combination of both from five different DNA fragments (Pieces A to E) as illustrated in FIG. 30.

Piece A (e.g., SEQ ID NO: 162)=>about 250 bp piece of the 5' untranslated region of Candida strain ATCC20336 FAO1 gene (from about position −500 to about −250).

Piece B (e.g., SEQ ID NO: 163)=>URA3 marker.

Piece C (e.g., SEQ ID NO: 164)=>about 50 bp of untranslated region of Candida strain ATCC20336 FAO1 (from position −300 to −250).

Piece D (e.g., SEQ ID NOS: 165, 166, 167)=>500 bp to 1 kb piece of the promoter of POX4, PEX11 or TEF1 gene, each obtained from Candida strain ATCC20336.

Piece E (SEQ ID NO: 168)=>First 250 bp of the coding sequence of FAO1 from Candida strain ATCC20336.

This Promoter Replacement DNA I integrates into at least one of the chromosomes but it may also integrate in both chromosomes depending on the nucleotide sequence divergence between the two chromosomes. The region of −1500 to +500 of the FAO1 gene is sequenced for both chromosomes. The −1500 to +500 area is PCR amplified with primers oBS1 and oBS2 using genomic DNA from ATCC20336. The PCR fragment is cloned into pCR-Blunt II Topo Multiple clones are sequenced and the sequence of the second allele is determined Pieces A, C and E and are changed to match the sequence of the second allele. A second promoter replacement cassette is constructed, sequence verified and named Promoter Replacement DNA II.

A Candida strain such as sAA103 is transformed with Promoter Replacement DNA cassette I. Transformants are selected by growth in ScD-ura plates. Colonies are streaked for single isolates. Correct insertion of the integrated piece is verified by PCR. A correct strain is grown in YPD overnight and plated in 5-FOA containing plates to select for the loop-out of the URA3 marker. Ura-strains are streaked for single isolates and loop out of URA3 is verified by PCR. This strain now has one FAO1 allele under the control of the POX4, PEX11 or TEF1 promoter.

The ura-strain is then transformed with the Promoter Replace DNA II molecule.

Transformants are selected by growth in ScD-ura plates. Colonies are streaked for single isolates. Correct insertion of the integrated piece in the second sister chromosome is verified by PCR. A correct strain is grown in YPD overnight and plated in 5-FOA containing plates to select for the loop-out of the URA3 marker. Ura-strains are streaked for single isolates and the loop out of URA3 is verified by PCR. This strain now has both alleles under the control of the POX4, PEX11 or TEF1 promoter.

This strain is then tested in fermentation for improved performance as compared with a strain not containing this genetic modification. DNA sequences for each fragment used in the constructs are set forth below:

SEQ ID NO: 162—Piece A (5' untranslated region of FAO1 (from position −500 to −250).
SEQ ID NO: 163—Piece B—URA3 marker.
SEQ ID NO: 164—Piece C.
SEQ ID NO: 165—Piece D—Promoter POX4.
SEQ ID NO: 166—Piece D—Promoter PEX11.
SEQ ID NO: 167—Piece D—Promoter TEF1.
SEQ ID NO: 168—Piece E—First 250 bp of the coding sequence of FAO1.

Example 56: Increasing NADPH Production by Overexpression of Cytosolic MAE1 and PYC2

The open reading frame of ScMAE1 (non-mitochondrial) and ScPYC2 are mutagenized to replace any CTG codon with other leucine-encoding codons. Two plasmids are constructed that replaces the Candida HFD2 of pAA712 open reading frame with either the ScMAE1 or the ScPYC2 open reading frame. A 3'URA3-$P_{POX4}$-ScMAE1*-$T_{POX4}$-5'URA3 or 3'URA3-$P_{POX4}$-ScPYC2-$T_{POX4}$-5'URA3 fragment are amplified with PCR using primers oAA2206 and oAA2209 and the corresponding plasmid, as template. The two PCR fragments are gel-purified, combined, and transformed into sAA103. Transformants are selected by growth in ScD-ura plates. Colonies are streaked for single colonies and transformants verified by PCR and copy number determined by qPCR. A strain is identified with approximately 5-10 copies of $P_{POX4}$-ScMAE1*-$T_{POX4}$ and 5-10 copies of $P_{POX4}$-ScPYC2-$T_{POX4}$ strain.

A parallel approach is taken by replacing ScMAE1 (non-mitochondrial) with the Candida MAE1 (non-mitochondrial). A strain is identified with approximately 5-10 copies of $P_{POX4}$-MAE1*-$T_{POX4}$ and 5-10 copies of $P_{POX4}$-ScPYC2-$T_{POX4}$.

The oligonucleotides listed in TABLE 29 below were selectively used in some of the following Examples.

TABLE 29

(SEQ ID NOS 359-463, respectively, in order of appearance)

| Oligo Designation | Nucleotide sequence |
| --- | --- |
| oAA0108 | CGACGGGTACAACGAGAATT |
| oAA0109 | AGACGAAGCCGTTCTTCAAG |
| oAA0634 | CACACACTGCAGTTTTCTTTCGTTCTCGTTCCGTCCTTC |
| oAA0635 | CACACATCTAGACCCGGGCTCTTCTCCTAGGGGTTATTTTATGTGATGATTATTATGATATAGTAGTC |
| oAA0722 | CCCGAAATATTACAATTGGAGCTCCAATAAATATTGTAATAAATAGGTCTATATACATACACTAAGCTTC |
| oAA0723 | CAATACAATTCTCGTTGTACCCGTCGAGACGAAGCCGTTCTTCAAGGTG |
| oAA0724 | CGACGGGTACAACGAGAATTGTATTG |
| oAA0727 | TTGTCAAGCAGCTTTATGGTTGTTTAGACGAAGCCGTTCTTCAAGGTG |
| oAA0730 | TTGTCAAGCAGCTTTATGGTTGTTT |
| oAA0731 | CCCGAAATATTACAATTGGAGCTCC |
| oAA2107 | CACACACTGCAGCTAGCAAAGGCTTGATCAGAGAAAGCAACA |
| oAA2108 | CACACATCTAGACCCGGGCTCTTCTGATTGTAGGGCGTTGGTGAGTAAGAACATT |
| oAA2109 | GAGCCCGGGTCTAGATGTGTGCTCTTCCTGGAAATCGAACTCGACGGTCACAA |
| oAA2110 | CACACACATATGAATTCGCCAACATGTTGGTTACTCTATGCATCGTACTTGGTATATTGATGTTGTTAATAGACTATA |

TABLE 29-continued (SEQ ID NOS 359-463, respectively, in order of appearance)

| Oligo Designation | Nucleotide sequence |
|---|---|
| oAA2135 | GAGCCCGGGTCTAGATGTGTGCTCTTCCGCTCCAGGCTTGTTAT GACTCTAGAGAGAAGTGTG |
| oAA2136 | CACACACATATGAATTCGGTCGGGTTTTGACCTTGGATATGAA ACTCAAAAATCATCAAATT |
| oAA2138 | CACACATCTAGACCCGGGCTCTTCTGGCTGCGTTGTGTATGGG TT |
| oAA2164 | CACACACTGCAGGAGGATGAAGAAGACGAAGA |
| oAA2206 | TTCCGCTTAATGGAGTCCAAA |
| oAA2207 | ATGATCTGCCATGCCGAACTAGACGAAGCCGTTCTTCAAG |
| oAA2208 | CTTGAAGAACGGCTTCGTCTAGTTCGGCATGGCAGATCAT |
| oAA2209 | TAAACGTTGGGCAACCTTGG |
| oAA2388 | AAGCTTTTAATTAACGTTGGGGTAAAACAACAGAGAG |
| oAA2389 | GGATCCGCATGCGGCCGGCCGTCGTGAAGATTTGAACAATGTT AGTG |
| oAA2390 | GGATCCGAGCTCGCGGCCGCGAATAGAAGAGAGTGACTCTTTT GATAAGAGTC |
| oAA2391 | GAATTCTTAATTAACATTGTTTGGAGAAAGAAGAAGAAGAAG |
| oAA2392 | GGATCCGAGCTCGCGGCCGCCCGAAACAACCATAAAGCTGC |
| oAA2394 | aacaGCGGCCGCtaaatattgtaataaataggtctatatacatacactaagcttctag |
| oAA2395 | aacaGCGGCCGCagacgaagccgttcttcaaggt |
| oAA2396 | aggaatacagatttatacaataaattgccatACaAGTcacgtgagatatctcatccattc |
| oAA2397 | gaatggatgagatatctcacgtgACTtGTatggcaatttattgtataaatctgtattcct |
| oAA2398 | acaGGATCCtagaggttgttctagcaaataaagtgtttca |
| oAA2399 | acaGCGGCCGCcgacgacgtgagtcagaacttg |
| oAA2400 | acaGGCCGGCCcgacgacgtgagtcagaacttg |
| oAA2401 | acaGGATCCcatcaagatcatctatggggataattacg |
| oAA2403 | acaGGCCGGCCcgacgacgtgagccagaact |
| oAA2656 | AAGCTTTTAATTAAAGATAATCACAGGGGTAGAGACCTTG |
| oAA2657 | GGATCCGCATGCGGCCGGCCGATAGCGTGGTATGAATGAATA AGTGTG |
| oAA2658 | GGATCCGAGCTCGCGGCCGCGAGCACTAGGTTTTGATAATTTG GTTCTTAC |
| oAA2659 | GAATTCTTAATTAACGGCGAAGAACATAGTGTGATG |
| oAA2888 | CACACAGCATGCGAGCTCCAATTGTAATATTTCG |
| oAA2888 | CACACAGCATGCGAGCTCCAATTGTAATATTTCG |
| oAA2889 | CACACACCCGGGGTCGACCTAAATTCGCAACTATCAACTAAGG |
| oAA2889 | CACACACCCGGGGTCGACCTAAATTCGCAACTATCAACTAAGG |
| oAA2890 | CACACACCCGGGGAGCTCCAATTGTAATATTTCGGG |
| oAA2890 | CACACACCCGGGGAGCTCCAATTGTAATATTTCGGG |
| oAA2891 | CACACAGCGGCCGCGTCGACCTAAATTCGCAACTATCAAC |
| oAA2891 | CACACAGCGGCCGCGTCGACCTAAATTCGCAACTATCAAC |

TABLE 29-continued (SEQ ID NOS 359-463, respectively, in order of appearance)

| Oligo Designation | Nucleotide sequence |
|---|---|
| oAA2902 | GTGGCAGCGTACAACTTACCG |
| oAA2903 | CTCCAACGTCAGAATCCCAAG |
| oAA2904 | cttgggattctgacgttggagcgacgggtacaacgagaattg |
| oAA2905 | CGAAGCCGTTCTTCAAGGTG |
| oAA2906 | caccttgaagaacggcttcgccgttatcgataccatctctaccc |
| oAA2907 | CGTTAGTGTATCACAAGGTCCTGACC |
| oAA3329 | ACAAGTGCACGTACTGTGACAAGGC |
| oAA3330 | ggagctccaattgtaatatttcggcgttacggtcgatagcaaaggggat |
| oAA3331 | aaacaaccataaagctgcttgacaaaataccgtctcagccatcatctacatcc |
| oAA3332 | TCAACACCGATCTAATTGGCGGCAACTGTGTTCCTG |
| oAA3333 | atccccttgctatcgaccgtaacgccgaaatattacaattggagctcc |
| oAA3334 | ggatgtagatgatggctgagacggtattttgtcaagcagctttatggttgttt |
| oAA3335 | TGTACCCTCAACCATACCCTGTGTTT |
| oAA3336 | ggagctccaattgtaatatttcggtgatttggacggtttgggacatttt |
| oAA3337 | aaacaaccataaagctgcttgacaacaaacagggtgtttagccaaccaaa |
| oAA3338 | CGGGTGTCGAGTTTGTAGATGTCTG |
| oAA3339 | aaaatgtcccaaaccgtccaaatcaccgaaatattacaattggagctcc |
| oAA3340 | tttggttggctaaacaccctgtttgttgtcaagcagctttatggttgttt |
| oAA3358 | CACACAGCTCTTCAGCCATGCTCGATCAGATCTTACATTACTGGTAC |
| oAA3359 | CACACAGCTCTTCGAGCCTATGACATCTTGACGTGTGCACC |
| oAA3378 | ATGCCTACCGAACTTCAAAAAGAA |
| oAA3379 | AACTCGTCAGTGTCTTCGTCAAAA |
| oAA3380 | TTTTGACGAAGACACTGACGAGTTCGACGGGTACAACGAGAACTG |
| oAA3381 | caccttgaagaacggcttcgGACAAGGGTTTCGACATTACCG |
| oAA3382 | TATTAACTGGACAAGATTTCAGCAGC |
| oAA3573 | GGCCTGACTGGCCTAATCAGGCGGCTCCTTCC |
| oAA3574 | GGCCTGGAAGGCCACGGCGGGTTGTTTGAGTTG |
| oAA3640 | GGCCTTCCTGGCCGAGGATGAAGAAGACGAAGACGAATTG |
| oAA3641 | GGCCTGAGAGGCCGGTCGGGTTTTGACCTTGG |
| oAA3643 | GGCCTCTCTGGCCTGAATTTTCTCAGGGCCGTG |
| oAA3644 | GGCCTTGCAGGCCTCTGTCTTGTTTGAGTTGATCGACTC |
| oAA3645 | GAGCTCGGCCGGCCATGGCTATGCTCAGTCAACCAAAC |
| oAA3648 | AAGCTTGGCCGGCCGCAGATGGTAAGGGTTCTACTTGG |
| oAA3692 | GAATTCGGCCGGCCACAAGTGCACGTACTGTGACAAGG |
| oAA3693 | GGCCCGAATGCGGATCCCCGGTCTGGCCCGTTACGGTCGATAGCAAAGGG |

TABLE 29-continued (SEQ ID NOS 359-463, respectively, in order of appearance)

| Oligo Designation | Nucleotide sequence |
|---|---|
| oAA3694 | GGATCCGCATTCGGGCCAGCACGGCCGCGGCCGCAATACCGTCTCAGCCATCATCTACATC |
| oAA3695 | TAGCGCATGCGGCCGGCCTCAACACCGATCTAATTGGCG |
| oAA3696 | GGCCCGAATGCGGATCCCCGGTCTGGCCCCTCCTTCTTGTTGGACCAAAAG |
| oAA3697 | GGATCCGCATTCGGGCCAGCACGGCCGCGGCCGCCCATTGGTGCTCAAAGAGTCATC |
| oAA3711 | Gggccagaccggccggatccgcattc |
| oAA3712 | Gaatgcggatccggccggtctggccc |
| oAA3789 | CACACAGCTCTTCCATAATGTATGCGACCAACGAAAAAAAAATTGAAATCTCCGACCTA |
| oAA3790 | CACACAGCTCTTCCCTCTCTTCTATTCTCAGCTTTTGCCGCCACTCAAG |
| oAA3804 | CACACACCTAGGATGTCAAGCTCAGATGAAGGAGATCACACTCCTGAGTTACAAC |
| oAA3805 | CACACATCTAGACTATTGGTTCATCATGTTAAACAAAGAATGAATGTCCTCGTCC |
| oAA3806 | CACACAGCTCTTCAATCATGTCAAGCTCAGATGAAGGAGATCACACTCCTGAGTTACAAC |
| oAA3807 | CACACAGCTCTTCTCCACTATTGGTTCATCATGTTAAACAAAGAATGAATGTCCTCGTC |
| oAA3930 | TTCCGCTTAATGGAGTCCAAAAAGA |
| oAA3931 | TCCCGAAATATTACAATTGGAGCTCTAGACGAAGCCGTTCTTCAAGGTGT |
| oAA3932 | ACACCTTGAAGAACGGCTTCGTCTAGAGCTCCAATTGTAATATTTCGGGA |
| oAA3933 | ATTCTCGTTGTACCCGTCGCATATGGTCGACCTAAATTCGCAACTATCAA |
| oAA3934 | TTGATAGTTGCGAATTTAGGTCGACCATATGCGACGGGTACAACGAGAAT |
| oAA3935 | TAAACGTTGGGCAACCTTGGAGGGGTGTGCTGATGCC |
| oAA4083 | GGCCTCTCTGGCCggtcgggttttgaccttg |
| oAA4084 | GGCCTACGAGGCCGAGGATGAAGAAGACGAAGACGAATTG |
| oAA4085 | GGCCTCGTTGGCCCAATTGTAATATTTCGGGAGAAATATCG |
| oAA4086 | GGCCTTGCAGGCCGTCGACCTAAATTCGCAACTATCAAC |

TABLE 30 sets forth the genetic modifications of selected Candida yeast strains described in the following Examples. The symbol "Δ" refers to a deletion of the gene preceding the symbol; "P450A" refers to CYP450A; "mig1Δ/MIG1" refers to deletion of one allele of the MIG1 gene.

TABLE 30

| Strain | Genetic Modifications |
|---|---|
| sAA2014 | pox4Δ pox5Δ mig1Δ/MIG1 ura3 |
| sAA2047 | pox4Δ pox5Δ mig1Δ |
| sAA2174 | pox4Δ pox5Δ CPRB P450A19 ADH2 ADH8 HFD2 |
| sAA2178 | pox4Δ pox5Δ CPRB P450A19 ADH2 ADH8 HFD2 |
| sAA1400 | pox4Δ pox5Δ CPRB ura3 |
| sAA1544 | pox4Δ pox5Δ CPRB ura3 |

TABLE 30-continued

| Strain | Genetic Modifications |
|---|---|
| sAA2115 | pox4Δ pox5Δ CPRB P450A19 ura3 |
| sAA1598 | pox4Δ pox5Δ CPRA CPRB ura3 |
| sAA1656 | pox4Δ pox5Δ CPRA ura3 |
| sAA2187 | pox4Δ pox5Δ CPRA CPRB P450A19 ura3 |
| sAA2313 | pox4Δ pox5Δ CPRA CPRB P450A19 |
| sAA2314 | pox4Δ pox5Δ CPRA CPRB P450A19 |
| sAA2355 | pox4Δ pox5Δ CPRA CPRB P450A19 ura3 |
| sAA2390 | pox4Δ pox5Δ mig1Δ/MIG1 CPRA CPRB P450A19 ADH8 PEX11 ZWF1 |
| sAA2433 | pox4Δ pox5Δ mig1Δ CPRA CPRB P450A19 ADH8 PEX11 ZWF1 |
| sAA2593 | pox4Δ pox5Δ mig1Δ CPRA CPRB P450A19 ADH8 PEX11 ZWF1 |
| sAA2466 | pox4Δ pox5Δ mig1Δ CPRA CPRB P450A19 ADH8 PEX11 ZWF1 ura3 |
| sAA2274 | pox4Δ pox5Δ CPRB P450A19 |
| sAA2687 | pox4Δ pox5Δ mig1Δ CPRA CPRB P450A19 ADH8 CcFAO1 PEX11 ZWF1 |
| sAA2693 | pox4Δ pox5Δ mig1Δ CPRA CPRB P450A19 ADH8 CcFAO1 PEX11 ZWF1 |
| sAA2356 | pox4Δ pox5Δ CPRA CPRB ura3 |
| sAA2552 | pox4Δ pox5Δ CPRA CPRB P450A19 UTR1 |
| sAA2671 | pox4Δ pox5Δ CPRA CPRB P450A19 ADH8 PEX11 ZWF1 FAT1 |
| sAA2672 | pox4Δ pox5Δ CPRA CPRB P450A19 ADH8 PEX11 ZWF1 FAT1 S244A |
| sAA2479 | pox4Δ pox5Δ CPRB P450A19 CTF1 |
| sAA1082 | pox4Δ pox5Δ CPRB P450A19 |

Example 57: Construction of Strain sAA2047 with Disrupted MIG1 Alleles

To create a *Candida* strain with decreased MIG1 expression, knockout cassettes for each MIG1 allele were generated. For the first allele, the 5'-homology region of MIG1 was amplified using primers oAA3329 and oAA3330 and ATCC20962 genomic DNA as template. The 3' homology region was amplified using the same genomic DNA and primers oAA3331 and oAA3332. A cassette containing the URA3 marker with a terminator repeated at the 5' end was amplified from plasmid pAA244 (described in Example 58) using oligos oAA3333 and oAA3334; this plasmid contains overlaps with both MIG1 homology regions. After PCR amplification, the DNA fragments from each PCR reaction were gel purified. All resulting DNA fragments were then used in a subsequent PCR reaction using oligos oAA3329 and oAA3332. The PCR purified cassette was then transformed into strain sAA103 (described above) and transformants were verified by PCR. One correctly transformed strain was named sAA1979. This strain was plated on 5FOA (procedure described above) to cure the URA3 marker and was verified by PCR. The strain without URA3 was designated as sAA2014.

The second MIG1 allele disruption cassette was generated as follows. A 5' homology region was amplified using primers oAA3335 and oAA3336. A 3' homology region was amplified using primers oAA3337 and oAA3338 and *Candida* ATCC20962 genomic DNA as a template. A cassette containing the URA3 marker with the terminator repeated was amplified using primers oAA3339 and oAA3340. The three fragments were then used in a subsequent PCR reaction to generate the deletion cassette using oligos oAA3335 and oAA3338. The purified cassette product was then transformed into strain sAA2014, and transformants were verified by PCR as having the second allele disrupted. A strain with the correct genotype was named sAA2047. MIG1 ORF and flanking regions are provided in SEQ ID NO:198.

Example 58: Construction of Strains sAA2174 and sAA2178

A 5'POX4-CPRB-$T_{URA3}$-URA3-3'POX4 ("$T_{URA3}$" means the terminator region of the URA3 gene) cassette was constructed as follows. The 5'flanking region of POX4 was amplified using primers oAA2388 and oAA2389 with genomic DNA obtained from ATCC strain 20336 as a template. The resulting fragment was gel purified and cloned into pCRTOPO Blunt II, sequence verified and the resulting plasmid was named pAA395. Separately, the 3' flanking region of POX4 was amplified from genomic DNA of ATCC strain 20336 using the primers oAA2390 and oAA2391. This amplified DNA fragment was cloned into pCR Topo Blunt II and sequence verified and the plasmid was named pAA396. Separately, the POX4 coding region from pAA395 was cut with HindIII and BamH1 and ligated with the BamH1 and EcoR1 to the POX4 coding sequence of pAA396; the ligation product was cloned into the HindIII and EcoRI sites of pUC19. The resulting plasmid was named pAA406.

A CPRB gene was amplified from genomic DNA of ATCC20336 using primers oAA2398 and oAA2399 or oAA2398 and oAA2400. The two resulting PCR fragments were separately cloned into pCR Topo Blunt II and each resulting CPRB insert was sequence verified to create plasmids pAA398 and pAA399, respectively. The CPRB coding region from pAA398 was cut with BamH1 and Not1 and ligated into the BamH1 and Not1 sites of pAA406 to form plasmid pAA418. Due to the orientation of CPRB in pAA399, the CPRB fragment was released by cutting the plasmid with BamH1. This BamH1 piece was ligated into the BamH1 site of pAA418 to form plasmid pAA415.

Plasmid pAA244 was prepared as follows: The URA3 terminator was amplified with primers oAA0722 and oAA0723 using pAA061 as a template. The URA3 gene cassette (promoter, open reading frame and terminator) was also amplified from pAA061 using primers oAA0724 and oAA0727. Both PCR products were combined and fused by PCR using primers oAA0730 and oAA0731. The $T_{URA3}$-URA3 PCR fragment was then cloned into pCR Topo Blunt II and a plasmid with the correct sequence was named pAA244.

Plasmid pAA244 was used as a template to PCR amplify a $T_{URA3}$-URA3 cassette using oligos oAA2394 and oAA2395. The amplified fragment was cloned into pCR Topo Blunt II, sequence verified and then designated as plasmid pAA402. Plasmid pAA402 served as a template for site directed mutagenesis with primers pAA2396 and pAA2397 to remove an internal SpeI site. The resulting plasmid was named pAA408. This URA3 cassette was cut with Not1 and ligated into the NotI site of pAA415 to create plasmid pAA450.

Strain sAA103 was transformed with a gel purified Pad fragment of pAA450 and transformants were selected by growth on ScD-ura plates. Correct integration of the 5'POX4⁻CPRB⁻CPRB⁻T$_{URA3}$-URA3-3'POX4 was verified by PCR. A strain with the correct genotype was named sAA1396. This strain was plated on 5FOA to cure the URA3 marker and was verified by PCR. The strain without URA3 was designated as sAA1400.

Strain sAA1400 was transformed with a PCR fragment containing URA3 flanked by POX4 flanking regions. The URA3 cassette was made by amplifying the 5' or 3' flanking region of POX4 from genomic DNA of ATCC20336 with primers oAA2902 and oAA2903 and oAA2906 and oAA2907. The URA3 of pAA450 was amplified using primers oAA2904 and oAA2905. The final cassette fragment was assembled by PCR using primers oAA2902 and oAA2907. Correct integration of the URA3 gene was verified by PCR. A strain with the correct genotype was named sAA1486. This strain was plated on 5FOA to cure the URA3 gene. This results in insertion of the CPRB gene The correct strain was named sAA1544.

Separately, a 5'POX5-2xP450A19-T$_{URA3}$-URA3-3'POX5 cassette was constructed as follows. The 5'flanking region of POX5 was amplified using primers oAA2656 and oAA2657. The 3' flanking region of POX5 was amplified from genomic DNA of ATCC20336 using primers oAA2658 and oAA2659. Each PCR fragment was separately cloned into pCR Topo Blunt II and the resulting POX5 insert of plasmid was sequence verified. The plasmids were named pAA494 and pAA495, respectively. The POX5 piece from pAA495 was cut with HindIII and BamH1 and ligated with the BamH1 and EcoR1 POX5 piece of pAA494 and cloned into the HindIII and EcoRI sites of pUC19. The resulting plasmid was named pAA620.

The gene encoding CYP450A19 from Candida strain ATCC 20336 was amplified from plasmid pAA156 using primers oAA2888 and oAA2889 or oAA2890 and oAA2891. The PCR fragments were separately cloned into pCR Topo Blunt II and sequence verified. The P450A19 pieces were digested with either Sph1 and Xma1, or XmaI and Not1, respectively, and ligated into the Sph1 and Not1 restriction sites of pAA620 to form pAA625. The Not1 URA3 piece of pAA448 was ligated into the Not1 restriction site of pAA625 to form pAA505.

Strain sAA1544 was transformed with a gel purified PAC1 fragment of pAA505 and transformants were selected by growth on ScD-ura plates. Correct integration of the 5'POX5-2xP450A19-T$_{URA3}$-URA3-3'POX4 was confirmed. A strain with the correct genotype was named sAA1816. This strain was plated on 5FOA to cure the URA3 marker and was verified by PCR. The strain without URA3 was designated as sAA1957.

Strain sAA1957 was transformed with a PCR fragment containing the URA3 gene flanked by POX5 flanking regions. This URA3 cassette was made by amplifying the 5' or 3' flanking region of POX5 from genomic DNA of ATCC20336 with primers oAA3378 and oAA3379 and oAA3381 and oAA3382. The URA3 gee from pAA450 was amplified using primers oA3380 and oAA2905. The complete fragment was assembled by PCR using primers oAA3378 and oAA3382. Correct integration was verified. A strain with the correct genotype was named sAA2042. This strain was plated on 5FOA to cure the URA3 marker. The correct strain was named sAA2115 (TABLE 30).

To create strains sAA2178 and sAA2174, strain sAA2115 was transformed with gel purified PCR amplification product for each of the following ATCC20962 genes: ADH2a, ADH8, HFD2 and CYP450A19 (TABLE 31). The sequence of each gene is set forth in Table 40. Two strains containing all of these genes were selected and named sAA2178 and sAA2174 (see TABLE 31).

TABLE 31

| Strain | Gene 1 | Source | Gene 2 | Source | Gene 3 | Source | Gene 4 | Source |
|---|---|---|---|---|---|---|---|---|
| sAA2174 | ADH2a | pAA711 | ADH8 | pAA-741 | HFD2 | pAA-712 | P450-A19 | pAA392 |
| sAA2178 | ADH2a | pAA711 | ADH8 | pAA-741 | HFD2 | pAA-712 | P450A19 | pAA392 |

Example 59: Construction of Strain sAA2433

A 5'POX4-CPRA-CPRB-T$_{URA3}$-URA3-3'POX4 cassette was constructed as follows: A CPRA gene was amplified from genomic DNA of Candida strain ATCC 20336 using primers oAA2401 and oAA2403. The resulting PCR fragment was cloned into pCR TOPO Blunt II and sequence verified and the resulting plasmid was named pAA401. A CPRB gene fragment was obtained by cutting plasmid p AA398 with BamH1 and Not 1; this fragment was ligated to the CPRA fragment amplified from pAA401 and the ligation product was cloned into the FseI and Not1 piece of pAA406 to create plasmid pAA417. The Not1 URA3 cassette from pAA408 was ligated into the Not1 site of paA417 to create plasmid pAA452.

Strain sAA103 was transformed with a gel purified Pad fragment of pAA452 and transformants were selected by growth on ScD-ura plates. Correct integration of the 5'POX4-CPRA-CPRB-T$_{URA3}$-URA3-3'POX4 cassette into the first allele of POX 4 was verified. A strain with the correct genotype was named sAA1596. This strain was plated on 5FOA to cure the URA3 gene. The strain without URA3 was designated as sAA1598.

Strain sAA1598 was transformed using standard transformation procedures with a PCR fragment prepared as follows: A URA3 cassette was created by amplifying the 5' or 3' flanking region of POX4 from genomic DNA of ATCC20336 with primers oAA2904 and oAA2905 (5') or primers oAA2906 and oAA2907 (3'). Separately, a URA3 gene from plasmid pAA450 was amplified using primers oAA2904 and oAA2905. A cassette fragment containing all 3 of the fragments described immediately above was assembled by PCR using primers oAA2902 and oAA2907. After transformation, the correct integration of the URA3 cassette was verified by PCR. A strain with the correct genotype was named sAA1653. This strain was plated on 5FOA to cure the URA3 gene, and the final strain (minus URA3) was named sAA1656.

Next, a cassette was generated that places the gene CYP450A19 under the control of either the POX4 or PEX11 promoter at both of the POX5 loci. To accomplish this, a 5'-POX5-2xP450A19-TURA3-URA3-3'-POX5 cassette was constructed as follows. A fragment containing the POX4 promoter ("PPOX4") and the CYP450A14 gene was created by amplifying two regions of pAA153 using primers oAA2888 and oAA2889 or oAA2890 and oAA2891. The two resulting PCR fragments were cloned into separate pCR Topo Blunt II plasmids and each was sequence verified. The PPOX4 and CYP450A19 pieces were digested with either Sph1 and Xma1, or Xma1 and Not1 respectively and ligated into the Sph1 and Not1 restriction sites of pAA620 to form pAA634. The Not1 URA3 piece of pAA448 was ligated into the Not1 restriction site of pAA634 to form pAA500.

The promoter and terminator of PEX11 were PCR amplified from genomic DNA obtained from Candida strain ATCC20336 using oligos oAA2164 and oAA2138 or oAA2135 and oAA2136, respectively. The two pieces were digested with either Pst1 and SmaI or NdeI and SmaI and ligated into the Pst1 and NdeI sites of pAA61 to form pAA335.

The open reading frame of P450A19 was amplified using oligos oAA3358 and oAA3359 and the PCR product was cloned as a SapI piece into the SapI restriction sites of pAA335. The resulting plasmid was sequenced and named pAA798. The PPEX11-P450A19-TPEX11 was moved as a XmaI-SphI fragment into the SmaI-SphI1 sites of pAA500. The resulting plasmid was named pAA800. The XmaI-ClaI restriction fragment of pAA505 (3137 bp in length) was ligated into the XmaI-ClaI fragment (6988 bp) of pAA800 to form pAA866.

Strain sAA1656 was transformed with a gel purified Pac1 fragment of pAA866 and transformants selected in ScD-ura plates. Correct integration of the 5'POX5-2xP450A19-TURA3-URA3-3'POX5 cassette was verified by PCR. A strain with the correct genotype was named sAA2123. This strain was plated on 5FOA to cure the URA3 marker and was verified by PCR. The strain without URA3 was designated as sAA2187. Strain sAA2187 was transformed with a with a gel purified Pac1 fragment of pAA866 and transformants selected in ScD-ura plates. Genotype was verified by PCR and two correct strains were named sAA2313 and sAA2314. sAA2313 was plated on 5FOA to cure the URA3 marker and was verified by PCR. The strain without URA3 was designated as sAA2355.

A 5'-MIG1-ADH8-PEX11-ZWF1-3'MIG1 deletion cassette was constructed. The 5' flanking region or 3' flanking region of MIG1 was amplified with primers oAA3692 and oAA3693 or oAA3694 and oAA3695, respectively. The two PCR fragments were combined by PCR using primers oAA3693 and oAA3695. Each fragment was purified and cloned separately into pCR Topo Blunt II. The insertion fragment in each plasmid was sequenced verified and cloned as a EcoR1 and SphI piece into pUC19. This plasmid was then modified by site-directed mutagenesis to generate a SfaI restriction site using oligos oAA3711 and oAA3712. The fragment was sequence and a clone having the sequence set forth in SEQ ID NO: 196 was selected. This plasmid was named pAA917.

The ADH8, PEX11, and ZWF1 genes were amplified from strain ATCC 20336 genomic DNA using primers oAA3573 and oAA3574, oAA3640 and oAAoAA3641, or oAA3643 and oAA3644, respectively. Each PCR fragment was separately cloned into pCR Topo Blunt II and the insert of each plasmid was sequenced. Plasmids containing the correct inserts were named pAA906, pAA881 and pAA914, respectively. All three gene inserts were cut out of their respective plasmids as SfiI fragments and ligated into the SfiI sites of pAA917. The resulting plasmid was named pAA944. The Not1 URA3 fragment of pAA408 was cloned into the Not1 site of pAA944 to form pAA946.

Strain sAA2355 was transformed with a gel purified Pac1 fragment of pAA946 and transformants selected in ScD-ura plates. Correct integration of the 5'MIG1-ADH8-PEX11-ZWF1-3'MIG1 was verified. A strain with the correct genotype was named sAA2390. This strain was plated on 5FOA to cure the URA3 marker and was verified. The strain without URA3 was designated as sAA2415. Strain sAA2415 was transformed with a gel purified Pac1 fragment of pAA946 and transformants were selected by growth on ScD-ura plates. A strain with the correct genotype was named sAA2433.

Example 60: Construction of Strains 2593 and 2687

A synthetic gene encoding Candida cloacae FAO1 linked on the 5' end to the ATCC20962 POX4 promoter and on the 3' end to the ATCC20962 terminator was created by standard DNA synthesis procedures. This synthetic construct was cloned into pCR Topo Blunt II. The plasmid was sequenced and named pAA1009. The sequence of this promoter-FAO1-terminator insert in pAA1009 is set forth as SEQ ID NO: 197.

Two URA3 fragments were amplified from pAA0073 using primers oAA3930 and oAA3931 or oAA3934 and oAA3935. These two pieces were combined with the PCR product of oAA3932 and oAA3935 from pAA1009. The piece was fused by PCR using primers oAA3930 and oAA3935. The PCR product was then cloned into pCR Topo Blunt II, sequence verified and named pAA1015.

Separately, a PEX11 expression cassette was prepared as follows: Two fragments were amplified from pAA336 using primers oAA2206 and oAA2207 or oAA2208 and oAA2209. These fragments were fused by PCR using primers oAA2206 and oAA2209 and the PCR product was cloned in pCR Topo Blunt II and sequence verified. A plasmid with the correct sequence was named pAA996.

Strain sAA2433 was plated on 5FOA to cure the URA3 marker. The genotype was verified and the strain was named sAA2466.

To create strains sAA2687 and sAA2693, strain sAA2466 was transformed with amplification cassettes for ATCC20962 ADH8, PEX11, Candida cloacae FAO1 and ATCC20962 CYP450A19. Each cassette was prepared using standard PCR techniques together with a template for each gene; the sequence of each gene used as a template is set forth in Example 75. Two strains containing all of these genes were named sAA2687 and sAA2693 (TABLE 32).

TABLE 32

| Strain | Gene 1 | Source | Gene 2 | Source | Gene 3 | Source | Gene 4 | Source |
|---|---|---|---|---|---|---|---|---|
| sAA2687 | ADH8 | pAA741 | P450A19 | AA392 | PEX11 | pAA996 | CcFAO1 | pAA1015 |
| sAA2693 | ADH8 | pAA741 | P450A19 | AA392 | PEX11 | pAA996 | CcFAO1 | pAA1015 |

Example 61: Production of a CTF+ Strain

The TEF1 promoter and terminator were PCR amplified from ATCC strain 20336 genomic DNA using oligos oAA2107 and oAA2108 or oAA2109 and oAA2110, respectively. The two PCR products were digested with either PstI and SmaI or PstI and NdeI and ligated into the PstI and NdeI sites of plasmid pAA61 to form pAA332.

The promoter of SSA3 was amplified from ATCC strain 20336 genomic DNA using primers oAA0634 and o0AA635. The PCR product was cloned into pCR Topo BluntII and the sequence was verified. The promoter piece was moved as a PstI and XbaI fragment into plasmid pAA73 to form plasmid pAA181.

To place CTF1 under the SSA1 promoter, CTF1 was PCR amplified from ATCC strain 20962 genomic DNA using primers oAA3804 and oAA3805. The PCR fragment was digested with AvrII and XbaI and ligated into the AvrII and XbaI sites of pAA181. This plasmid was verified by sequencing and was named pAA990.

To place CTF1 under the TEF1 promoter, CTF1 was PCR amplified as using primers oAA3806 and oAA3807. The PCR fragment was digested with SapI and the two fragments were ligated into the SapI sites of plasmid pAA332. Two plasmids were selected and the insert in each was verified by sequencing. These identical plasmids were named pAA1017 and pAA1018.

Plasmids pAA990, pAA1017, and pAA1018 were linearized within the URA3 gene at the ClaI site by restriction digestion and the linear plasmid was purified. The linearized products were then transformed into strains sAA2115 and sAA2356. Resultant transformants were verified by PCR and the following strains were created (TABLE 33).

TABLE 33

| Parental Strain | Plasmid | New Strain |
|---|---|---|
| sAA2115 | pAA990 | sAA2479 |
| sAA2356 | pAA990 | sAA2481 |
| sAA2115 | pAA1017 | sAA2574 |
| sAA2356 | pAA1018 | sAA2577 |

Strain sAA2115 was transformed with the URA3 PCR fragment amplified from pAA061 using oligos oAA0108 and oAA0109. Transformants were selected in ScD-ura. A Ura+ strain was named sAA2274.

Example 62: Creation of a UTR1 Overexpression Strain

A gene encoding UTR1 (SEQ ID NO: 200) was amplified from strain ATCC20336 genomic DNA using oligos oAA3789 and oAA3790. The PCR fragment was cloned as a SapI fragment into the SapI sites of pAA73 to form pAA975. The gene was verified by sequencing. This plasmid was digested with SpeI and transformed into strain sAA2466. Transformants were selected in ScD-ura. A Ura+ transformant with integrated UTR1 was named sAA2552.

Example 63: Creation of FAT1 and FAT1 S244A Mutant Overexpression Strains

Plasmids pAA635 and pAA637 were digested with ClaI and transformed into sAA2466. Transformants were selected in ScD-ura. A Ura+ with multiple copies of FAT1 integrated was named sAA2671 and a Ura+ strain with multiple copies of FAT1 S244A was named sAA2672

Example 64: Di-Acid Production by Selected CTF+ and CTF− Strains

Shake flask fermentations were conducted to determine the effect of CTF1 on production of di-acids from a methyl laurate feedstock as follows: Strains sAA2274, sAA2479, sAA2574, sAA2314, sAA2481 and sAA2577 were inoculated into separate shake flasks containing 50 mL of SP92 medium containing 50 g/L glucose and grown overnight. The cultures for each were pelleted by centrifugation and the cells resuspended in 25 mL of DCA3 medium prepared as follows: About 6.7 g of yeast nitrogen and 50 g of dextrose were dissolved in water to a final volume of 500 mL. Separately, a phosphate solution was prepared by adding 7.7 g of monobasic potassium phosphate and 42.4 g of dibasic potassium phosphate to water to a final volume of 500 ml. The solutions were combined and filter sterilized.

Bottom baffled flasks were used for this fermentation. To duplicate flasks for each strain 12.5 mL of culture was added. To each flask 250 uL of methyl-laurate was added and the flasks incubated at 30° C. for 40 hrs. with shaking at 300 rpm. Flasks were sampled by removal of 1 mL at 18 and 40 hrs. for gas chromatograph analysis. Results (in grams of DDDA per liter of fermentation broth) are shown in TABLE 34.

TABLE 34

| | HDDA (g/L) | | DDDA (g/L) | | | |
|---|---|---|---|---|---|---|
| Strain | 18 hr. | 40 hr. | 18 hr. | 40 hr. | | CTF1 |
| 2274-1 | 0.14 | 0.41 | 0.51 | 0.62 | 4xCPRB 4x P450A19 | − |
| 2274-2 | 0.65 | 0.97 | 1.06 | 1.27 | 4xCPRB 4x P450A19 | − |
| 2479-1 | 0.47 | 0.64 | 2.27 | 2.67 | 4xCPRB 4x P450A19 | + |
| 2479-2 | 0.47 | 0.67 | 2.31 | 2.86 | 4xCPRB 4x P450A19 | + |
| 2574-1 | 0.67 | 0.79 | 1.59 | 1.78 | 4xCPRB 4x P450A19 | + |
| 2574-2 | 0.62 | 0.8 | 1.37 | 1.58 | 4xCPRB 4x P450A19 | + |
| 2314-1 | 0.23 | 0.38 | 0.72 | 0.73 | 2xCPRA 2xCPRB 4x P450A19 | − |
| 2314-2 | 0.26 | 0.49 | 0.92 | 0.99 | 2xCPRA 2xCPRB 4x P450A19 | − |
| 2481-1 | 0.11 | 0.31 | 1.77 | 2.07 | 2xCPRA 2xCPRB 4x P450A19 | + |
| 2481-2 | 0.08 | 0 | 1.47 | 3.06 | 2xCPRA 2xCPRB 4x P450A19 | + |
| 2577-1 | 0.29 | 0.41 | 0.69 | 0.75 | 2xCPRA 2xCPRB 4x P450A19 | + |
| 2577-2 | 0.25 | 0.38 | 0.64 | 0.69 | 2xCPRA 2xCPRB 4x P450A19 | + |

The results indicate that the promoter for SSA3 expressing CTF1b boosts conversion of methyl-laurate to dodecanedioic acid in both host backgrounds, with a reduction in omega-hydroxy fatty acid (HDDA) seen in the sAA2356 host background. The strain containing the TEF promoter expressing CTF1b also displayed increased dodecanedioic acid (DDDA) production compared to the control strain for the sAA2115 background. However, this was not observed for the sAA2356 background and may be due to lower copy number of the CTF1b gene.

Example 65: Conversion of Methyl Laurate to DDDA—Comparison of Strain sAA2047 to Strain ATCC 20962

A pre-culture of 80 mL of SP92 medium (6.7 g/L yeast nitrogen base, 3.0 g/L yeast extract, 3.0 g/L $(NH_4)_2SO_4$, 1.0 g/L $K_2HPO_4$, 1.0 g/L $KH_2PO_4$, 75 g/L dextrose) in a 500 mL baffled flask with foam plugs was inoculated with 1.0 mL from a frozen glycerol stock of strain ATCC 20962 or strain sAA2047 and incubated for 24 h at 30° C. and 250 RPM. Fermentation medium (MM1), pH 5.8 was filter sterilized and transferred to a sterile fermentation vessel. Growth was initiated with an inoculum of pre-culture to an initial $OD_{600\ nm}=1.0$ and growth conditions of 35° C., 1000 rpm, 1 vvm, pH 5.8. Growth continued for approximately 10-12 h at which point the conversion phase was initiated by a continuous feed of methyl laurate. Feedstock feed rates varied as follows: methyl laurate (Sigma-Aldrich #W271500), 0.7 g/L-h for the first 24 h; 1.0 g/L-h from 24 h to termination. In addition, a co-feed of dextrose was fed at a rate of 1.25 g/L-h. At induction, the temperature was changed to 30° C. and the pH was maintained at 6.0 by addition of 6N KOH.

DDDA productivity (average of triplicate fermentations) for strain sAA2047 was 0.585 g/L-h (grams of DDDA per liter of fermentation broth per hour) while strain sAA0003 showed a productivity of 0.543 g/L-h, which is a difference of about 8 percent. Strain sAA2047 also produced lower levels of both lauric acid and 12-hydroxy lauric acid than strain sAA0003. Lauric acid levels were reduced almost 60% and 12-hydroxy lauric acid levels were reduced by 25%.

Example 66: Conversion of Methyl Laurate to DDDA—Comparison of Strains sAA2174 and sAA2178 to sAA1082

A pre-culture of 80 mL of SP92 medium in a 500 mL baffled flask with foam plugs was inoculated with 1.0 mL from a frozen glycerol stock either of strain sAA1082, sAA2074, or sAA2078 and incubated for 24 h at 30° C. and 250 RPM. Fermentation medium (MM1) at pH 5.8 was filter sterilized and transferred to a sterile fermentation vessel. Growth was initiated with an inoculum of pre-culture to an initial $OD_{600\ nm}=1.0$ and growth conditions of 35° C., 1000 rpm, 1 vvm, pH 5.8. Growth continued for approximately 10-12 h at which point the conversion phase was initiated by a continuous feed of feedstock. Methyl laurate feed rates were 0.75 g/L-h for the first 24 h and 1.4 g/L-h from 24 h to termination. In addition, a co-feed of dextrose was fed at a rate of 1.25 g/L-h. At induction, the temperature was changed to 30° C. and the pH was maintained at 6.0 by addition of 6N KOH.

DDDA productivity (average of triplicate fermentations) for strain sAA2178 was 0.896 g/L-h and strain sAA2174 was 0.879 g/L-h while sAA1082 showed a productivity of 0.820 g/L-h, an improvement of about 8% for sAA2178 and 7.2% for sAA2174 over strain sAA1082. Both sAA2178 and sAA2174 produced lower levels of lauric acid than strain sAA1082. Lauric acid levels were reduced by 50% for sAA2174 and by 26% for sAA2178 relative to sAA1082. Lowering the amount of lauric acid improves the overall yield of DDDA from methyl laurate.

Example 66.1: Conversion of Ethyl Laurate to DDDA—Comparison of Strain sAA2433 to sAA2671

A pre-culture of 80 mL SP92 (6.7 g/L yeast nitrogen base, 3.0 g/L yeast extract, 3.0 g/L (NH4)2SO4, 1.0 g/L K2HPO4, 1.0 g/L KH2PO4, 75 g/L dextrose) in a 500 mL baffled flask with foam plugs was inoculated with 1.0 mL from a frozen glycerol stock of strain sAA2433 or strain sAA2047 and incubated for 24 h at 30° C. and 250 RPM. Fermentation medium (MM1), pH 5.8 was filter sterilized and transferred to a sterile fermentation vessel. Growth was initiated with an inoculum of pre-culture to an initial OD600 nm=1.0 and growth conditions of 35° C., 1000 rpm, 1 vvm, pH 5.8. Growth continued for approximately 10-12 h at which point the conversion phase was initiated by a continuous feed of ethyl laurate, which was fed at a rate of 0.75 g/L-h for the first 24 h; 1.28 g/L-h from 24 h to termination. In addition, a co-feed of dextrose was fed at a rate of 0.9 g/L-h. At induction, the temperature was changed to 30° C. and the pH was maintained at 6.0 by addition of 6N KOH. The main difference between these two strains is the fact that strain sAA2671 has a gene for fatty acid transport (FAT1) amplified, which is not the case for sAA2433. DDDA productivity for strains was similar at about 0.8 g/L-h. However, strain 2433 produced 4.0 g/L of lauric acid and strain sAA2671 produced only 0.3 g/L. This difference can be attributed to the fact that, if lauric acid is produced by de-esterification of ethyl laurate and is subsequently released into the broth, it will be more readily transported back into the cell for bioconversion to DDDA in a strain that has been amplified for FAT1 i.e. sAA2671. A 25% reduction in the accumulation of 12-hydroxy lauric acid in the broth was also observed with strain sAA2671.

Example 66.2: Conversion of ethyl laurate to DDDA—comparison of strains sAA2593, sAA2687 and sAA2693 to sAA2178

A pre-culture of 80 mL SP92 in a 500 mL baffled flask with foam plugs was inoculated with 1.0 mL from a frozen glycerol stock either of strain sAA2593 sAA2687 or sAA2693, or sAA2178 and was incubated for 24 h at 30° C. and 250 RPM. Fermentation medium (MM1) at pH 5.8 was filter sterilized and transferred to a sterile fermentation vessel. Growth was initiated with an inoculum of pre-culture to an initial OD600 nm=1.0 and growth conditions of 35° C., 1000 rpm, 1 vvm, pH 5.8. Growth continued for approximately 10-12 h at which point the conversion phase was initiated by a continuous feed of feedstock. Ethyl laurate feed rates were 0.75 g/L-h for the first 24 h and 1.49 g/L-h from 24 h to termination. In addition, a co-feed of dextrose was fed at a rate of 0.9 g/L-h. At induction, the temperature was changed to 30° C. and the pH was maintained at 6.0 by addition of 6N KOH. DDDA productivity (average of duplicate fermentations) for all strains was similar at about 0.83 g/L-h. However, strains sAA2687 and 2693 (both with *Candida cloacae* FAO1 genes amplified), accumulated 24% and 47% lower levels of hydroxyl fatty acids, respectively, than either sAA2178 or sAA2593, neither of which have an amplified FAO gene. In addition, strain sAA2687 accumulated at least 55% less lauric acid than any of the other three strains.

Example 67: Production of DDDA from Ethyl Laurate or Methyl Laurate Feedstock

Fermentations were carried out with strain sAA1082 grown in MM1 medium with dextrose as growth substrate but using either methyl laurate or ethyl laurate (Sigma-Aldrich #W244112) as feedstock. A pre-culture of 80 mL SP92 in a 500 mL baffled flask with foam plugs was inoculated with 1.0 mL from a frozen glycerol stock of strain sAA1082 (beta-oxidation blocked strain plus amplified CPRB and CYP52A19) and incubated for 24 h at 30° C. and 250 RPM. Fermentation medium (MM1) at pH 5.8 was filter sterilized and transferred to a sterile fermentation vessel. Growth was initiated with an inoculum of pre-culture to an initial $OD_{600\ nm}=1.0$ and growth conditions of 35° C., 1000 rpm, 1 vvm, pH 5.8. Growth continued for approximately 10-12 h at which point the conversion phase was initiated by a continuous feed of feedstock. Methyl laurate feed rates varied as follows: 0.75 g/L-h for the first 24 h; 1.2 g/L-h from 24 h to termination. Ethyl laurate was fed at a rate of 0.75 g/L-h for the first 24 h; 1.28 g/L-h from 24 h to termination. At induction, the temperature was changed to 30° C. and the pH was maintained at 6.0 by addition of 6N KOH. Also at induction a co-feed of dextrose was fed at a rate of either 1.25 g/L-h or 0.9 g/L-h. In TABLE 35, data from these two ethyl laurate fermentations were compared to similar data obtained from methyl laurate fermentations run under the same conditions.

The results are the averages of duplicate fermentations. These data indicate that ethyl laurate substitutes quite well for methyl laurate. Both ethyl laurate fermentations with dextrose feed rates of either 1.25 g/L-h or 0.9 g/L-h showed good DDDA productivity. The higher dextrose feed had an improvement in productivity of about 6% over the methyl laurate fermentation with similar co-feed rate. Both ethyl laurate fermentations showed a significant decrease in the 12-hydroxy lauric acid (HFA) concentration compared to either of the methyl laurate fermentations. The ethyl laurate fermentations also had the lowest lauric acid accumulation, which is an advantage, since lauric acid can accumulate to toxic levels and eventually inhibit productivity. An additional benefit for using ethyl laurate is that no significant quantity of ethanol was observed to accumulate in the broth. Ethanol in the off-gas was not determined, but it should be quite low, since the ethanol would be slowly released from ethyl laurate and would be consumed quickly before it would evaporate to the off-gas. The final beneficial result was that the dextrose:DDDA ratio decreased significantly, since ethanol is a very good energy source and substitutes well for dextrose. When the ethyl laurate fermentation results are compared to methyl laurate fermentations having the same co-feed rates (1.25 g/L-h and 0.9 g/L-h) a very large difference is seen. Decreasing the co-feed to 0.9 g/L-h with methyl laurate caused a decrease in productivity (relative to the 1.25 g/L-h co-feed rate) and resulted in a significant increase in lauric acid accumulation and also resulting in a significant decrease in DDDA purity. In contrast, with the ethyl laurate fermentations the lower dextrose feed resulted in only a slight decrease in productivity and both the lauric acid concentration and the HFA concentration showed a small increase in concentration, resulting in a small decrease in purity. The lower dextrose:DDDA ratio could result in a significant decrease in the cost of producing DDDA from ethyl laurate compared to methyl laurate. In TABLE 35, "Purity" refers to the amount of DDDA in the fermentation broth relative to all other chain lengths of fatty acids and diacids in the broth.

TABLE 35

| Feed | Co-Feed Rate (g/L-h) | Productivity (g/L-h) | HFA (g/L) | Lauric Acid (g/L) | Dextrose:DDDA (g/g) | Purity (%) |
|---|---|---|---|---|---|---|
| Methyl Laurate | 1.25 | 0.832 | 3.83 | 3.88 | 1.60 | 84.8 |
| Methyl Laurate | 0.9 | 0.638 | 3.31 | 8.36 | 1.90 | 73.0 |
| Ethyl Laurate | 1.25 | 0.879 | 1.64 | 0.71 | 1.40 | 92.5 |
| Ethyl Laurate | 0.9 | 0.832 | 2.48 | 2.00 | 1.07 | 90.0 |

Example 68: Production of DDDA Using Sucrose or Dextrose as a Co-Feed

A pre-culture of 80 mL SP92 in a 500 mL baffled flask with foam plugs was inoculated with 1.0 mL from a frozen glycerol stock of strain sAA2178 (beta-oxidation blocked strains plus amplified CPRB, CYP52A19, ADH2a, ADH8, and HFD2) and incubated for 24 h at 30° C. and 250 RPM. Fermentation medium (MM1) at pH 5.8 was filter sterilized and transferred to a sterile fermentation vessel. For the control, dextrose was used for both growth and co-feed. For the experimental fermentations, sucrose was substituted on a g/g basis for dextrose in both the growth medium (MM1) and in the co-feed. Growth was initiated with an inoculum of pre-culture to an initial $OD_{600\ nm}=1.0$ and growth conditions of 35° C., 1000 rpm, 1 vvm, pH 5.8. Growth continued for approximately 10-12 h at which point the conversion phase was initiated by a continuous feed of ethyl laurate. Ethyl laurate was fed at a rate of 0.75 g/L-h for the first 24 h; 1.28 g/L-h from 24 h to termination. In addition, a co-feed of either dextrose or sucrose was fed at a rate of 0.9 g/L-h for all fermentations. At induction, the temperature was changed to 30° C. and the pH was maintained at 6.0 by addition of 6N KOH. The data from three fermentations were averaged for the comparison.

With dextrose as co-feed, the production of DDDA was 0.872 g/L-h and with sucrose the production of DDDA was only about 3% less at 0.847 g/L-h. The fermentations with sucrose as co-feed accumulated a bit more lauric acid (1.56 g/L) and HFA (1.78 g/L) than the fermentations with dextrose as co-feed (lauric acid=0.52 g/L and HFA=1.44 g/L). Because of this the fermentations with sucrose as co-feed had slightly lower purity (92.2%) than the fermentations with glucose as co-feed (94.3%). Overall, sucrose substituted well for dextrose.

Example 69: Alternative Co-Feed—Substitution of Glycerol or Xylose for Dextrose in DDDA Production A pre-culture of 80 mL SP92 in a 500 mL baffled flask with foam plugs was inoculated with 1.0 mL from a frozen glycerol stock of strain sAA2178 (beta-oxidation blocked strains plus amplified CPRB, CYP52A19, ADH2a, ADH8, and HFD2) and incubated for 24 h at 30° C. and 250 RPM. Fermentation medium (MM1) at pH 5.8 was filter sterilized and transferred to a sterile fermentation vessel. For the control, dextrose was used for both growth and co-feed. For the experimental fermentations, glycerol or xylose was substituted on a g/g basis for dextrose in both the growth medium (MM1) and in the co-feed. Growth was initiated with an inoculum of pre-culture to an initial $OD_{600\ nm}=1.0$ and growth conditions of 35° C., 1000 rpm, 1 vvm, pH 5.8. Growth continued for approximately 10-12 h at which point the conversion phase was initiated by a continuous feed of ethyl laurate. Ethyl laurate was fed at a rate of 0.75 g/L-h for the first 24 h; 1.28 g/L-h from 24 h to termination. In addition, a co-feed of either dextrose, glycerol or xylose was fed at a rate of 1.25 g/L-h for all fermentations. At induction, the temperature was changed to 30° C. and the pH was maintained at 6.0 by addition of 6N KOH.

With dextrose as co-feed, the production of DDDA was 0.825 g/L-h; with glycerol the production of DDDA was about 60% less at 0.327 g/L-h and with xylose the production of DDDA was about 75% less at 0.211 g/L-h. The fermentations with glycerol and xylose as co-feed accumulated a lot more lauric acid (12.28 g/L and 19.04 g/L, respectively) than the fermentation with dextrose as co-feed (0.37 g/L). HFA levels were very low in the fermentations with glycerol (0.33 g/L) or xylose (0.20 g/L) relative to dextrose (1.24 g/L) in part because they produced significantly less DDDA. Because of the large accumulation of lauric acid, the DDDA purity in the fermentations with glycerol or xylose (39.6% and 28.9% purity, respectively) as co-feed was significantly worse than the DDDA purity in the dextrose fermentation (93.4%). On a g/g basis, substituting either glycerol or xylose for dextrose as co-feed results in fermentations with lower productivity, greater accumulation of lauric acid, and lower overall DDDA purity.

Example 70: Production of DDDA: Use of Ethanol or Dextrose as a Co-Feed

A pre-culture of 80 mL SP92 in a 500 mL baffled flask with foam plugs was inoculated with 1.0 mL from a frozen glycerol stock of strain sAA1082 (beta-oxidation blocked strains plus amplified CPRB and CYP52A19) and was incubated for 24 h at 30° C. and 250 RPM. Fermentation medium (MM1) at pH 5.8 was filter sterilized and transferred to a sterile fermentation vessel. For the control, dextrose was used for both growth and co-feed. For the experimental fermentations, glycerol or xylose was substituted on a g/g basis for dextrose in both the growth medium (MM1) and in the co-feed. Growth was initiated with an inoculum of pre-culture to an initial $OD_{600\ nm}=1.0$ and growth conditions of 35° C., 1000 rpm, 1 vvm, pH 5.8. Growth continued for approximately 10-12 h at which point the conversion phase was initiated by a continuous feed of methyl laurate. Methyl laurate was fed at a rate of 0.7 g/L-h for the first 24 h; 1.2 g/L-h from 24 h to termination. In addition, a co-feed of ethanol was fed at a rate of 0.7 g/L-h. The ethanol feed rate was reduced relative to what would normally be used for glucose (1.2 g/1-h), since ethanol is theoretically a more energy-rich compound. At induction, the temperature was changed to 30° C. and the pH was maintained at 6.0 by addition of 6N KOH.

Substituting ethanol for dextrose as co-feed at the feed rate selected resulted in a fermentation with lower DDDA productivity (0.446 g/L) than that seen for dextrose, which resulted in a greater accumulation of lauric acid (8.5 g/L) HFA (5.3 g/L), and methyl laurate (38 g/L) and a lower overall DDDA purity (33%).

Example 71: Conversion of Methyl Decanoate to Sebacic Acid (Decanedioic Acid)—Comparison of Strain sAA1082 to sAA2178

A pre-culture of 80 mL SP92 in a 500 mL baffled flask with foam plugs was inoculated with 1.0 mL from a frozen glycerol stock of strain sAA2178 or strain sAA1082 and incubated for 24 h at 30° C. and 250 RPM. Fermentation medium (MM1) at pH 5.8 was filter sterilized and transferred to a sterile fermentation vessel. Growth was initiated with an inoculum of pre-culture to an initial $OD_{600\ nm}=1.0$ and growth conditions of 35° C., 1000 rpm, 1 vvm, pH 5.8. Growth continued for approximately 10-12 h at which point the conversion phase was induced by the a bolus of 10 g/L of decane (Sigma-Aldrich #457116) for 6 h after which a continuous feed of methyl decanoate (TCI America #D0023) at 0.25 or 0.50 g/L-h was initiated. Because of the volatility of decane, the aeration rate was reduced to 0.3 vvm during the 6-h induction phase with decane as inducer. In addition, a co-feed of dextrose was fed at a rate of 1.25 g/L-h for all fermentations. At induction, the temperature was changed to 30° C. and the pH was maintained at 6.0 by addition of 6N KOH.

The results in TABLE 36 below show the production of decanedioic acid (sebacic acid) reported as "Productivity" (grams of sebacic acid produced per liter of fermentation broth per hour) and compare the productivity of the two strains under the different feed rates. "Methyl Decanoate" refers to the amount of methyl decanoate, the feedstock, present at the end of each fermentation. Both strains sAA1082 and sAA2178 were able to produce sebacic acid well when the feed rate was at 0.25 g/L-h, but, when the feed rate was increased to 0.5 g/L-h, strain sAA1082 produced significant amounts of decanoic acid and 10-hydroxy decanoic acid, and accumulated methyl decanoate; the sebacic acid purity was greatly reduced as a result. Because of the toxicity of accumulated decanoic acid, the productivity was significantly reduced. Strain sAA2178, however, showed a strong increase in productivity when the feed rate of methyl decanoate was increased to 0.5 g/L-h and had little to no accumulation of either decanoic acid, 10-hydroxy decanoic acid or methyl decanoate.

TABLE 36

| Strain | Methyl Decanoate Feed Rate (g/L-h) | Productivity (g/L-h) | Decanoic Acid (g/L) | 10-OH Decanoic Acid (g/L) | Methyl Decanoate (g/L) | Purity (%) |
|---|---|---|---|---|---|---|
| sAA1082 | 0.25 | 0.143 | 0 | 0.03 | 0.07 | 92.6 |
| sAA1082 | 0.5 | 0.092 | 8.8 | 3 | 10.2 | 28.2 |
| sAA2178 | 0.25 | 0.194 | 0 | 0.06 | 0 | 93.3 |
| sAA2178 | 0.5 | 0.361 | 0 | 0.184 | 0 | 95.6 |

Example 72: Diacid Production from Feedstocks of Varying Carbon Chain Lengths

The bioconversion tests in this Example were undertaken following a shake flask protocol. On day 1, 5 ml of YPD was inoculated with a fresh colony of Candida strain ATTC 20962, sAA1082, or sAA2178. The YPD contained 10 g/L yeast extract, 20 g/L peptone, and 20 g/L dextrose. These cultures were then placed in a 30° C. shaking incubator at 250 rpm for 18 to 20 hours.

After this growth phase, these cultures were used to inoculate 350 ml of SP92-glycerol media dispensed into 10-250 ml wide mouth flasks in 35 ml aliquots for each strain. The SP92-glycerol media contained 6.7 g/L yeast nitrogen base, 3 g/L yeast extract, 3 g/L ammonium sulfate, 1 g/L potassium phosphate monobasic, 1 g/L potassium phosphate dibasic, and 75 g/L glycerol (Picataggio S., et al., Biotechnology (N Y). 1992 August; 10(8):894-8). The cultures were then placed in a 30° C. shaking incubator at 300 rpm for 20 to 24 hours.

The cells were then centrifuged for 5 minutes at 3000 rpm and the supernatant discarded. The cells were resuspended in DCA3 medium supplemented with 1.0% triton-X100. DCA3 is a 0.3M potassium phosphate buffer, pH7.5 containing 6.7 g/L yeast nitrogen base and 50 g/L glycerol. Variations of DCA3 media recipes are known, non-limiting examples of which include the addition of dextrose and/or glycerol, the like or combinations thereof. DCA3 media, as referred to herein, can include dextrose and/or glycerol. After re-suspension, the OD600 nm for each culture was adjusted to a common OD (based on the available OD for the strain with the least growth) and 10 ml was transferred to pre-weighed 250 ml bottom baffled shake flasks. The flasks were then reweighed to determine the starting weight of the culture. The substrate to be converted was then added at 1% v/v for ethyl esters and 3% v/v for alkanes. The increased amount of alkanes added was due to their volatility to ensure that sufficient substrate remained in solution for bioconversion. The flasks were weighed once more to determine the exact amount of substrate added to each flask and were then placed in a 30° C. shaking incubator at 300 rpm for 48 hours. Bioconversion tests for ethyl stearate and ethyl palmitate were performed at 35° C. due to melting point limitations for these substrates.

After 48 hours, the flasks were weighed once more to determine the weight of the final culture. The cultures were mixed well by swirling and 1 ml was transferred to a pre-weighed 15 ml falcon tube containing 0.8 ml of 6N HCl. The tube was weighed to determine the density of the final culture and this number used to determine the culture volume present at the final time point. Samples were submitted to analytical for analysis by GC.

TABLE 37

| Feedstock | Carbon Chain length | Temp (° C.) | Starting OD | Feedstock Yield (g diacid/ g added feedstock) | | | % improvement over ATTC 20962 | |
|---|---|---|---|---|---|---|---|---|
| | | | | ATTC-20962 | sAA-1082 | sAA-2178 | sAA-1082 | sAA-2178 |
| Ethyl tetradecanoate | 14 | 30 | 125 | 0.347 | 0.404 | 0.444 | 16.5 | 28.1 |
| Ethyl palmitate | 16 | 35 | 75 | 0.059 | 0.084 | 0.090 | 41.8 | 51.2 |
| Ethyl stearate | 18 | 35 | 75 | 0.074 | 0.085 | 0.143 | 14.5 | 92.7 |
| n-Undecane | 11 | 30 | 125 | 0.312 | 0.386 | 0.403 | 23.7 | 29.3 |
| n-Tridecane | 13 | 30 | 75 | 0.680 | 0.941 | 0.868 | 38.3 | 27.7 |
| n-pentadecane | 15 | 30 | 75 | 0.505 | 0.673 | 0.590 | 33.1 | 16.8 |
| n-heptadecane | 17 | 30 | 75 | 0.473 | 0.555 | 0.514 | 17.3 | 8.6 |

Example 73: Conversion of Ethyl Decanoate to Decanedoic Acid (Sebacic Acid)

Bioconversion tests for ethyl decanoate were performed in 0.5 L Infors HT Multifors bioreactors (Infors AG, Switzerland) with working volumes of 0.4 L each. A pre-culture of 50 mL SP92 (6.7 g/L yeast nitrogen base, 3.0 g/L yeast extract, 3.0 g/L $(NH_4)_2SO_4$, 1.0 g/L $K_2HPO_4$, 1.0 g/L $KH_2PO_4$, 75 g/L dextrose) in a 250 mL baffled flask with foam plugs was inoculated with a single colony from a fresh plate of Candida strain ATCC 20962, strain sAA1082, or strain sAA2178 and incubated for 24 h at 30° C. and 250 RPM. Fermentation medium (MM1), pH 5.8 was filter sterilized and transferred to a sterile fermentation vessel. Bioreactors were equipped with two rushton impellers rotating at 1000 rpm. Bioreactors were inoculated to an OD of approximately 0.2 and growth continued for approximately 12-14 hours, at which point the conversion phase was initiated by evenly space boluses of ethyl decanoate. Culture pH was kept constant at 5.8 during the growth phase by automatic addition of 6 N KOH and temperature and airflow were controlled at 30° C. and 1 vvm respectively.

At induction, the pH was changed to 6.2 and maintained by addition of 6N KOH. Bioreactors were induced with an initial 4.0 ml bolus of decane for 6 hours with an airflow rate of 0.25 vvm to minimize evaporation. Minimal decanedioic acid (sebacic acid) was observed following this initial induction period, indicating that the majority of the decane was lost to evaporation.

Following this initial 6 hour induction, airflow was increased to 1 vvm and 58 µl of ethyl decanoate was added every 30 minutes for the next 6 hours. Ethyl decanoate boluses were then increased to 116 µl at a frequency of once per hour for the next 36 hours. In addition, a co-feed of dextrose was fed at a rate of 1.25 g/L-h. Final samples were taken 12 hours after the final ethyl decanoate bolus. Yield calculations were made for all cultures taking only added ethyl decanoate into account due to the volatility of decane and the lack of decanedioic acid formation following the initial induction period. The results are shown in TABLE 38 below. As can be seen, strains sAA1082 and sAA2178 produced significantly more sebacic acid than did strain ATCC 20962.

TABLE 38

| Feedstock | Chain length | Temp (° C.) | Starting OD | Feedstock Yield (g sebacic acid/g feedstock) | | | % improvement over ATTC 20962 | |
|---|---|---|---|---|---|---|---|---|
| | | | | ATCC20962 | sAA1082 | sAA2178 | sAA1082 | sAA2178 |
| Ethyl decanoate | 10 | 30 | 0.2 | 0.685 | 1.088 | 1.032 | 58.9 | 50.7 |

Example 74: Shake Flask Evaluation of a MIG1 Mutant Stain

Shake flask fermentations were conducted to determine the effect of deletion of MIG1 on production of di-acids from a methyl laurate or oleic acid feedstock as follows: Strains ATCC ATCC20962 (sAA003) and sAA2047 were inoculated into separate shake flasks containing 50 mL of SP92 medium containing 50 g/L glucose and grown overnight. The cultures for each were pelleted by centrifugation and the cells resuspended in 25 mL of DCA3 medium prepared as follows: About 6.7 g of yeast nitrogen and 50 g of dextrose were dissolved in water to a final volume of 500 mL. Separately phosphate solution was prepared by adding 7.7 g of monobasic potassium phosphate and 42.4 g of dibasic potassium phosphate to water to a final volume of 500 ml. The solutions were combined and filter sterilized.

Bottom baffled flasks were used for this fermentation. To duplicate flasks for each strain 12.5 mL of culture was added. To each flask 250 uL of methyl-laurate or oleic acid was added and the flasks incubated at 30° C. for 40 hrs. with shaking at 300 rpm. Flasks were sampled by removal of 1 mL 24 hrs. for gas chromatograph analysis.

The results are shown in TABLE 39A & 39B below. In the tables, "HDDA" refers to hydroxy dodecane acid. As is apparent, strain sAA2047 containing a MIG1 deletion showed higher production of diacids from both oleic acid and methyl-laurate fermentation as compared with strain ATCC 20962. Significantly, there was a concomitant reduction of hydoxy fatty acids in the fermentation broth of strain sAA2047 as compared with strain ATCC 20962.

TABLE 39A

Oleic Acid Shake Flask Fermentation

|  | Omega hydroxy-Oleic Acid (g/L) | cis-9 C18 diacid (g/L) |
|---|---|---|
| ATCC20962 | 0.503 | 2.933 |
| sAA2047 | 0.260 | 3.057 |

TABLE 39B

Methyl Laurate Shake Flask Fermentation

|  | 12-HDDA (g/L) | DDDA (g/L) |
|---|---|---|
| ATCC20962 | 0.960 | 1.493 |
| sAA2047 | 0.300 | 1.637 |

Example 75: Certain Nucleotide and Amino Acid Sequences for Genetic Modification

TABLE 40

| SEQ ID NO: | Description | Sequence |
|---|---|---|
| SEQ ID NO 1: | Thioesterase activity *Cuphea lanceolata* Amino acid (A.A. Seq) | MVAAAATSAFFPVPAPGTSPKPGKSGNWPSSLSPTFKPKSIPN AGFQVKANASAHPKANGSAVNLKSGSLNTQEDTSSSPPPRAF LNQLPDWSMLLTAITTVFVAAEKQWTMLDRKSKRPDMLVD SVGLKSIVRDGLVSRQSFLIRSYEIGADRTASIETLMNHLQET SINHCKSLGLLNDGFGRTPGMCKNDLIWVLTKMQIMVNRYP TWGDTVEINTWFSQSGKIGMASDWLISDCNTGEILIRATSVW AMMNQKTRRFSRLPYEVRQELTPHFVDSPHVIEDNDQKLHK FDVKTGDSIRKGLTPRWNDLDVNQHVSNVKYIGWILESMPIE VLETQELCSLTVEYRRECGMDSVLESVTAVDPSENGGRSQY KHLLRLEDGTDIVKSRTEWRPKNAGTNGAISTSTAKTSNGNS AS |
| SEQ ID NO: 2 | FAO-13 (fatty alcohol oxidase activity) *C. Tropicalis* Nucleotide (Nuc. Seq) | atggctccatttttgcccgaccaggtcgactacaaacacgtcgacacccttatgttattatgtgacg ggatcatccacgaaaccaccgtcgaccaaatcaaagacgttattgctcctgacttccctgctgac aagtacgaagagtacgtcaggacattcaccaaaccctccgaaaccccaggggttcagggaaacc gtctacaacacagtcaacgcaaacaccacggacgcaatccaccagttcattatcttgaccaatgtt ttggcatccagggtcttggctccagtttgaccaactcgttgacgcctatcaaggacatgagcttg gaagaccgtgaaaaattgttggcctcgtggcgcgactcccaatcgctgccaaaaggaagttgtt caggttggtttctacgcttaccttggtcacgttcacgagattggccaatgagttgcatttgaaagcc attcattatccaggaagagaagaccgtgaaaaggctttatgaaacccaggagattgaccctttaa gtaccagttttttggaaaaaccgaagttttacggcgctgagttgtacttgccagatattgatgtgatca ttattggatctggtgccggtgctggtgttgtggcccacacttttggccaacgatggcttcaagagttt ggttttggaaaagggcaaatactttagcaactccgagttgaactttgatgacaaggacggcgttca agaattataccaaagtggaggtactttgactacagtcaaccaacagttgtttgttcttgctggttcca cttttggtggcgtaccactgtcaattggtcagcctgtcttaagacgccattcaaggtgcgtaagg aatggtatgatgagtttggtgttgactttgctgctgatgaagcatacgataaagcgcaggattatgtt tggcagcaaatgggagcttctaccgaaggcatcacccactctttggctaacgagttattattgaa ggtggtaagaaattaggttacaaggccaaggtattagaccaaaacagcggtggtcatcctcagc acagatgcggtttctgttatttgggcgtaagcacggtatcaagcaggttctgttaataactggttt agagacgcagctgcccacggttcccagttcatgcaacaggttagagttttgcaaatacttaacaa gaagggatcgcttacggtatctgtgtgaggatgttgtaaccggcgccaagttcaccattactgg ccccaaaaagtttgttgttgctgccggtgctttgaacactccatctgtgttggtcaactccggcttca agaacaagaacatcggtaagaacttaactttgcaccccagtttctgtcgtgtttggtgattttggcaaa gacgttcaagcagaccacttccacaactccatcatgactgcccttgttcagaagccgctgattta gacggcaagggccatggatgcagaattgaaaccatcttgaacgctccattcatccaggcttcatt cttaccatggagaggtagtaacgaggctagacgagacttgttgcgttacaacaacatggtggcg atgttgctccttagtcgtgacaccaccagtggttccgtttctgtcatccaaccaaaacctgaagcttt ggttgtcgagtacgacgtgaacaagtttgacagaaactcgatcttgcaggcattgttggtcactgc tgacttgttgtatatccaaggtgccaagagaatcctagtccacaggcatgggtgccaatttttgaa tccgacaagccaaaggataagagatcaatcaaggacgaggactatgtcgaatggagagccaa ggttgccaagattccttcgacacctacggctcaccttatggttcggcacatcaaatgtcttcttgcc gtatgtcaggtaagggtcctaaatacggtgctgttgacaccgatggtagattgtttgaatgttcgaa tgtttatgttgccgatgcaagtcttttgccaactgcaagcggtgccaaccctatggtcaccaccatg actcttgccagacatgttgcgttaggtttggcagactccttgaagaccaaagccaagttgtag |
| SEQ ID NO: 3 | FAO-13 (fatty alcohol oxidase activity) *C. Tropicalis* A.A. Seq | MAPFLPDQVDYKHVDTLMLLCDGIIHETTVDQIKDVIAPDFP ADKYEEYVRTFTKPSETPGFRETVYNTVNANTTDAIHQFIILT NVLASRVLAPALTNSLTPIKDMSLEDREKLLASWRDSPIAAK RKLFRLVSTLTLVFTRLANELHLKAIHYPGREDREKAYETQ EIDPFKYQFLEKPKFYGAELYLPDIDVIIGSGAGAGVVAHTL ANDGFKSLVLEKGKYFSNSELNFDDKDGVQELYQSGGTLTT VNQQLFVLAGSTFGGGTTVNWSACLKTPFKVRKEWYDEFG VDFAADEAYDKAQDYVWQQMGASTEGITHSLANEIIIEGGK KLGYKAKVLDQNSGGHPQHRCGFCYLGCKHGIKQGSVNNW FRDAAAHGSQFMQQVRVLQILNKKGIAYGILCEDVVTGAKF TITGPKKFVVAAGALNTPSVLVNSGFKNKNIGKNLTLHPVSV VFGDFGKDVQADHFHNSIMTALCSEAADLDGKGHGCRIETIL NAPFIQASFLPWRGSNEARRDLLRYNNMVAMLLLSRDTTSG SVSAHPTKPEALVVEYDVNKFDRNSILQALLVTADLLYIQGA KRILSPQAWVPIFESDKPKDKRSIKDEDYVEWRAKVAKIPFD TYGSPYGSAHQMSSCRMSGKGPKYGAVDTDGRLFECSNVY VADASLLPTASGANPMVTTMLARHVALGLADSLKTKAKL |

TABLE 40-continued

| SEQ ID NO: | Description | Sequence |
|---|---|---|
| SEQ ID NO: 4 | FAO-17(fatty alcohol oxidase activity) *C. Tropicalis* Nuc. Seq | atggctccattttttgcccgaccaggtcgactacaaacacgtcgacacccttatgttattatgtgacg<br>ggatcatccacgaaaccaccgtggacgaaatcaaagacgtcattgcccctgacttccccgccga<br>caaatacgaggagtacgtcaggacattcaccaaaccctccgaaacccccagggttcagggaaac<br>cgtctacaacaccgtcaacgcaaacaccatggatgcaatccaccagttcattatcttgaccaatgt<br>tttgggatcaaggggtcttggcaccagctttgaccaactcgttgactcctatcaaggacatgagcttg<br>gaagaccgtgaaaagttgttagcctcgtggcgtgactccctattgctgctaaaaggaagttgttc<br>aggttggtttctacgcttaccttggtcacgttcacgagattggccaatgagttgcatttgaaagccat<br>tcattatccaggaagagaagaccgtgaaaaggcttatgaaacccaggagattgacccttttaagt<br>accagttttttggaaaaaccgaagttttacgcgctgagttgtacttgccagatattgatgtgatcatt<br>attggatctggtgccggtgctggtgttgtggcccacacttttggccaacgatggcttcaagagtttg<br>gtttttggaaaagggcaaatactttagcaactccgagttgaactttgatgacaaggacggcgttcaa<br>gaattataccaaagtggaggtacttttgactacagtcaaccaacagttgtttgttcttgctggttccac<br>ttttggtggcggtaccactgtcaattggtcagcctgtcttaagacgccattcaaggtgcgtaagga<br>atggtatgatgagtttggtgttgactttgctgctgatgaagcatacgataaagcgcaggattatgttt<br>ggcagcaaatgggagcttctaccgaaggcatcacccactctttggctaacgagattattattgaag<br>gtggtaagaaattaggttacaaggccaaggtattagaccaaaacagcggtggtcatcctcagca<br>cagatgcggtttctgttatttgggttgtaagcacggtatcaagcagggctctgttaataactggttta<br>gagacgcagctgcccacggttctcagttcatgcaacaggttagagttttgcaaatccttaacaaga<br>agggcatcgcttatggtatcttgtgtgaggatgttgtaaccggtgccaagttcaccattactggccc<br>caaaaagtttgttgttgccgccggcgccttaaacactccatctgtgttggtcaactccggattcaag<br>aacaagaacatcggtaagaacttaactttgcatccagtttctgtcgtgtttggtgattttggcaaaga<br>cgttcaagcagaccacttccacaactccatcatgactgccctttgttcagaagccgctgatttagac<br>ggcaagggccatggatgcagaattgaaaccatcttgaacgctccattcatccaggcttcattctta<br>ccatggagaggtagtaacgaggctagacgagacttgttgcgttacaacaacatggtggcgatgtt<br>gctccttagtcgtgacaccaccagtggaccgtttctgctcatccaaccaaacctgaagctaggtt<br>gtcgagtacgacgtgaacaagtttgacagaaactcgatcttgcaggcattgttggtcactgctgac<br>ttgagtatatccaaggtgccaagagaatccttagtccacagcatgggtgccaattttttgaatccg<br>acaagccaaaggataagagatcaatcaaggacgaggactatgtcgaatggagagccaaggttg<br>ccaagattcctttcgacacctacggctcacctatggttcggcacatcaaatgtcttcttgccgtatg<br>tcaggtaagggtcctaaatacggtgctgttgacaccgatggtagattgatgaatgttcgaatgttta<br>tgttgccgatgcaagtcttttgccaactgcaagcggtgccaaccctatggtcaccaccatgactctt<br>gcaagacatgttgcgttaggtaggcagactccttgaagaccaaggccaagttgtag |
| SEQ ID NO: 5 | FAO-17(fatty alcohol oxidase activity) *C. Tropicalis* A.A. Seq | MAPFLPDQVDYKHVDTLMLLCDGIIHETTVDEIKDVIAPDFP<br>ADKYEEYVRTFTKPSETPGFRETVYNTVNANTMDAIHQFIIL<br>TNVLGSRVLAPALTNSLTPIKDMSLEDREKLLASWRDSPIAA<br>KRKLFRLVSTLTLVTFTRLANELHLKAIHYPGREDREKAYET<br>QEIDPFKYQFLEKPKFYGAELYLPDIDVIIIGSGAGAGVVAHT<br>LANDGFKSLVLEKGKYFSNSELNFDDKDGVQELYQSGGTLT<br>TVNQQLFVLAGSTFGGGTTVNWSACLKTPFKVRKEWYDEF<br>GVDFAADEAYDKAQDYVWQQMGASTEGITHSLANEIIIEGG<br>KKLGYKAKVLDQNSGGHPQHRCGFCYLGCKHGIKQGSVNN<br>WFRDAAAHGSQFMQQVRVLQILNKKGIAYGILCEDVVTGA<br>KFTITGPKKFVVAAGALNTPSVLVNSGFKNKNIGKNLTLHPV<br>SVVFGDFGKDVQADHFHNSIMTALCSEAADLDGKGHGCRIE<br>TILNAPFIQASFLPWRGSNEARRDLLRYNNMVAMLLLSRDTT<br>SGSVSAHPTKPEALVVEYDVNKFDRNSILQALLVTADLLYIQ<br>GAKRILSPQAWVPIFESDKPKDKRSIKDEDYVEWRAKVAKIP<br>FDTYGSPYGSAHQMSSCRMSGKGPKYGAVDTDGRLFECSN<br>VYVADASLLPTASGANPMVTTMTLARHVALGLADSLKTKA<br>Kl |
| SEQ ID NO: 6 | FAO-20(fatty alcohol oxidase activity) *C. Tropicalis* Nuc. Seq | atggctccattttttgcccgaccaggtcgactacaaacacgtcgacacccttatgttattatgtgacg<br>ggatcatccacgaaaccaccgtcgaccaaatcaaagacgttattgcctcctgacttccctgctgac<br>aagtacgaagagtacgtcaggacattcaccaaaccctccgaaacccccagggttcagggaaacc<br>gtctacaacacagtcaacgcaaacaccacgtgcaatccaccagttcattatcttgaccaatgtt<br>ttggcatccagggtcttggcctcagctttgaccaactcgttgacgccatcaaggacatgagcttg<br>gaagaccgtgaaaaattgttggcctcgtggcgcgactccccaatcgctgccaaaaggaaattgtt<br>caggttggtttccacgcttaccttggttactttcacgagattggccaatgagttgcatttgaaagcca<br>ttcactatccaggaagagaagaccgtgaaaaggcttatgaaacccaggagattgaccctttcaag<br>taccagttttatgaaaagccaaagtttgacggcgctgagttgtacttgccagatattgatgttatcat<br>tattggatctggtgccggtgctggtgttgtggcccacacttttggccaacgatggcttcaagagtttg<br>gtttttggaaaagggcaaatactttagcaactccgagttgaactttgatgacaaggacggcgttcaa<br>gaattataccaaagtggaggtacttttgactacagtcaaccaacagttgtttgttcttgctggttccac<br>ttttggtggcggtaccactgtcaattggtcagcctgtcttaagacgccattcaaggtgcgtaagga<br>atggtatgatgagtttggtgttgactttgctgctgatgaagcatacgataaagcgcaggattatgttt<br>ggcagcaaatgggagcttctaccgaaggcatcacccactctttggctaacgagattattattgaag<br>gtggtaagaaattaggttacaaggccaaggtattagaccaaaacagcggtggtcatcctcagca<br>cagatgcggtttctgttatttgggctgtaagcacggtatcaagcagggtctgttaataactggttta<br>gagacgcagctgcccacggttcccagttcatgcaacaggttagagttttgcaaatacttaacaag<br>aaggggatcgcttacggtatcttgtgtgaggatgttgtaaccggcgccaagttcaccattactggc<br>cccaaaaagtttgttgttgctgccggtgctttgaacactccatctgttgttggtcaactccggcttca<br>gaacaagaacatcggtaagaacttaactttgcacccagttctctgtcgtgtttggtgattttggcaaa<br>gacgttcaagcagaccacttccacaactccatcatgactgccctttgttcagaagccgctgattta<br>gacggcaagggccatggatgcagaattgaaaccatcttgaacgctccattcatccaggcttcatt<br>cttaccatggagaggtagtaacgaggctagacgagacttgttgcgttacaacaacatggtggcg<br>atgttgctccttagtcgtgacaccaccagtggtccgtttctgctcatccaaccaaacctgaagcttt |

TABLE 40-continued

| SEQ ID NO: | Description | Sequence |
|---|---|---|
| | | ggttgtcgagtacgacgtgaacaagtttgacagaaactcgatcttgcaggcattgttggtcactgc tgacttgttgtatatccaaggtgccaagagaatcctagtccacaggcatgggtgccaattttgaa tccgacaagccaaaggataagagatcaatcaaggacgaggactatgtcgaatggagagccaa ggttgccaagattcctttcgacacctacggctcacctatggttcggcacatcaaatgtcttcttgcc gtatgtcaggtaagggtcctaaatacggtgctgttgacaccgatggtagattgtttgaatgttcgaa tgtttatgttgccgatgcaagtcttttgccaactgcaagcggtgccaaccctatggtcaccaccatg actcttgccagacatgttgcgttaggtttggcagactccttgaagaccaaagccaagttgtag |
| SEQ ID NO: 7 | FAO-20 (fatty alcohol oxidase activity) *C. Tropicalis* A.A. Seq | MAPFLPDQVDYKHVDTLMLLCDGIIHETTVDQIKDVIAPDFP ADKYEEYVRTFTKPSETPGFRETVYNTVNANTTDAIHQFIILT NVLASRVLAPALTNSLTPIKDMSLEDREKLLASWRDSPIAAK RKLFRLVSTLTLVTFTRLANELHLKAIHYPGREDREKAYETQ EIDPFKYQFMEKPKFDGAELYLPDIDVIIIGSGAGAGVVAHTL ANDGFKSLVLEKGKYFSNSELNFDDKDGVQELYQSGGTLTT VNQQLFVLAGSTFGGGTTVNWSACLKTPFKVRKEWYDEFG VDFAADEAYDKAQDYVWQQMGASTEGITHSLANEIIIEGGK KLGYKAKVLDQNSGGHPQHRCGFCYLGCKHGIKQGSVNNW FRDAAAHGSQFMQQVRVLQILNKKGIAYGILCEDVVTGAKF TITGPKKFVVAAGALNTPSVLVNSGFKNKNIGKNLTLHPVSV VFGDFGKDVQADHFPHNSIMTALCSEAADLDGKHGCRIETIL NAPFIQASFLPWRGSNEARRDLLRYNNMVAMLLLSRDTTSG SVSAHPTKPEALVVEYDVNKFDRNSILQALLVTADLLYIQGA KRILSPQAWVPIFESDKPKDKRSIKDEDYVEWRAKVAKIPFD TYGSPYGSAHQMSSCRMSGKGPKYGAVDTDGRLFECSNVY VADASLLPTASGANPMVTTMTLARHVALGLADSLKTKAKL |
| SEQ ID NO: 8 | FAO-2a (fatty alcohol oxidase activity) *C. Tropicalis* Nuc. Seq | atgaataccttcttgccagacgtgctcgaatacaaacacgtcgacacccttttgttattgtgtgacg ggatcatccacgaaaccacagtcgatcagatcaaggacgccattgctcccgacttccctgagga ccagtacgaggagtatctcaagaccttcaccaagccatctgagacccctgggttcagagaagcc gtctacgacacgatcaacgccaccccaaccgatgccgtgcacatgtgtattgtcttgaccaccgc attggactccagaatcttggccccccacgttgaccaactcgttgacgcctatcaaggatatgacctt gaaggagcgtgaacaattgttggcctcttggcgtgattccccgattgcggcaaagagaagattgt tcagattgatttcctcgcttaccttgacgacgatacgagattggccagcgaattgcacttgaaagc catccactaccctggcagagactttgcgtgaaaaggcgtatgaaacccaggtggttgacccttca ggtacctgatatggagaaaccaaagtttacggcgccgaattgtacttgccagatatgcgacgtca tcatcattggatcaggcgccggtgctggtgtcatggcccacactctcgccaacgacgggttcaa gacctggattggaaagggaaagtattcagcaactccgagttgaacttaatgacgctgatgg cgtgaaagagttgtaccaaggtaaaggtgctttggccaccaccaatcagcagatgtttattcttgc cggttccactagggcggttggtaccactgtcaactggtctgcttgccttaaaaacaccattaaagtg cgtaaggagtggtacgacgagtttggtcttgaatttgctgccgatgaagcctacgacaaagcgca ggattatgttggaaacaaatgggtgcttcaacagatggaatcactcactccttggccaacgaagt tgtgggagaaggaggtaagaagttgggctacaagagcaaggaaattgagcagaacaacggtgg ccaccctgaccacccatgtggatcttgcttacttgggctgtaagtacggtattaaacagggttctgtg aataactggtttagagacgcagctgcccacgggtccaagttcatgcaacaagtcagagttgtgca aatcctcaacaagaatggcgtcgcttatggtatcttgtgtgaggatgtcgaaaccggagtcaggtt cactattagtggccccaaaaagtttgttgatctgctggttctttgaacacgccaactgtgttgacca actccggattcaagaacaagcacattggtaagaacttgacgttgcaccccagttccaccgtgtttg gtgacttcgcagagacgtgcaagccgaccatttccacaaatctattatgacttcgctttgttacga ggttgctgacttggacggcaaggggccacggatgcagaatcgaaaccatcttgaacgctccattc atccaagcttctttgttgccatggagaggaagtgacgaggtcagaagagacttgttgcgttacaac aacatggtggccatgttgcttatcacgcgtgataccaccagtggacagatctgctgacccaaag aagcccgacgattgattcgactatgagattaacaagtttgacaagaatgccatcttgccaagctt tcttgatcacttccgacatgttgtacattgaaggtgccaagagaatcctcagtccacagccatggg tgccaatctttgagtcgaacaagccaaaggagcaaagaacgatcaaggacaaggactatgttga gtggagagccaaggctgctaagataccttcgacacctacggtctgcatatgggtccgcacatc aaatgtccacctgtcgtatgtccggaaagggtcctaaatacggtgctgagactgtggtagatt gttgaatgttcgaatgtctatgttgctgatgctagtgttttgcctactgccagcggtgccaacccaa tgatatccaccatgacctttgctagacagattgcgttaggtttggctgactccttgaagaccaaacc caagttgtag |
| SEQ ID NO: 9 | FAO-2a (fatty alcohol oxidase activity) *C. Tropicalis* A.A. Seq | MNTFLPDVLEYKHVDTLLLLCDGIIHETTVDQIKDAIAPDFPE DQYEEYLKTFTKPSETPGFREAVYDTINATPTDAVHMCIVLT TALDSRILAPTLTNSLTPIKDMTLKEREQLLASWRDSPIAAKR RLFRLISSLTLTTFTRLASELHLKAIHYPGRDLREKAYETQV DDPFRYSFMEKPKFDGAELYLPDIDVIIIGSGAGAGVMAHTLA NDGFKTLVLEKGKYFSNSELNFNDADGVKELYQGKGALATT NQQMFILAGSTLGGGTTVNWSACLKTPFKVRKEWYDEFGLE FAADEAYDKAQDYVWKQMGASTDGITHSLANEVVVEGGK KLGYKSKEIEQNNGGHPDHPCGFCYLGCKYGIKQGSVNNWF RDAAAHGSKFMQQVRVVQILNKNGVAYGILCEDVETGVRF TISGPKKFVVSAGSLNTPTVLTNSGFKNKHIGKNLTLHPVSTV FGDPFGRDVQADHFHKSIMTSLCYEVADLDGKHGCRIETILN APFIQASLLPWRGSDEVRRDLLRYNNMVAMLLITRDTTSGSV SADPKKPDALIVDYEINKFDKNAILQAFLITSDMLYIEGAKRI LSPQPWVPIFESNKPKEQRTIKDKDYVEWRAKAAKIPFDTYG SAYGSAHQMSTCRMSGKGPKYGAVDTDGRLFECSNVYVAD ASVLPTASGANPMISTMTFARQIALGLADSLKTKPKL |

TABLE 40-continued

| SEQ ID NO: | Description | Sequence |
|---|---|---|
| SEQ ID NO: 10 | FAO-2b(fatty alcohol oxidase activity) *C. Tropicalis* Nuc. Seq | atgaataccttcttgccagacgtgctcgaatacaaacacgtcgataccctttgttattatgtgacgg gatcatccacgaaaccacagtcgaccagatcagggacgccattgctcccgacttccctgaagac cagtacgaggagtatctcaagaccttcaccaagccatctgagacccctggggttcagagaagccg tctacgacacgatcaacagcaccccaaccgaggctgtgcacatgtgtattgtattgaccaccgca ttggactcgagaatcttggcccccacgttgaccaactcgttgacgcctatcaaggatatgaccttg aaagagcgtgaacaattgttggcgcctggcgtgattcccgatcgcggccaagagaagattgtt cagattgatttcctcacttaccttgacgacctttacgagattggccagcgacttgcacttgagagcc atccactaccctggcagagacttgcgtgaaaaggcatatgaaacccaggtggttgaccctttcag gtacctgttttatggaaaaaccaaagttttgacggcaccgagttgtacttgccagatatcgacgtcat catcattggatccggtgccggtgctggtgtcatggcccacactttagccaacgacgggtacaag accttggttttggaaaagggaaagtatttcagcaactccgagttgaactttaatgatgccgatggta tgaaagagttgtaccaaggtaaatgtgcgttgaccaccacgaaccagcagatgtttattcttgccg gttccactttgggcggtggtaccactgttaactggtctgcttgtcttaaaacaccattttaaagtgcgt aaggagtggtacgacgagtttggtcttgaatttgctgccgacgaagcctacgacaaagcacaag actatgtttggaaacaaatgggcgcttctaccgaaggaatcactcactctttggcgaacgcggttg tggttgaaggaggtaagaagtttgggttacaagagcaaggaaatcgagcagaacaatggtggcc atcctgaccaccctgtggtttctgttacttgggctgtaagtacggtattaagcagggttctgtgaat aactggtttagagacgcagctgcccacgggtccaagttcatgcaacaagtcagagttgtgcaaat cctccacaataaaggcgtcgcttatggcatcttgtgtgaggatgtcgagaccggagtcaaattca ctatcagtggccccaaaaagtttgttgtttctgcaggttctttgaacacgccaacggtgttgaccaa ctccggattcaagaacaaacacatcggtaagaacttgacgttgcaccccagtttcgaccgtgtttgg tgactttggcagagacgtgcaagccgaccatttccacaaatctattatgacttcgctctgttacgaa gtcgctgacttggacggcaagggccacggatgcagaatcgagaccatcttgaacgctccattca tccaagcttcttttgttgccatggagaggaagcgacgaggtcagaagagacttgttgcgttacaac aacatggtggccatgttgcttatcacccgtgacaccaccagtggttcagtactgctgacccaaag aagcccgacgattgattgtcgactatgacatcaacaagtttgacaagaatgccatcttgcaagctt tcttgatcacctccgacatgttgtacatcgaaggtgccaagagaatcctcagtccacaggcatgg gtgccaatctttgagtcgaacaagccaaaggagcaaagaacaatcaaggacaaggactatgtc gaatggagagccaaggctgccaagatacctttcgacacctacggttctgcctatgggtccgcac atcaaaatgtccacctgtcgtatgtccggaaagggtcctaaatacggcgccgttgataccgatggt agattgtttgaatgttcgaatgtctatgttgctgatgctagtgttttgcctactgccagcggtgccaac ccaatgatctccaccatgacgtttgctagacagattgcgttaggaggctgactctttgaagacca aacccaagttgtag |
| SEQ ID NO: 11 | FAO-2b(fatty alcohol oxidase activity) *C. Tropicalis* A.A. Seq | MNTFLPDVLEYKHVDTLLLLCDGIIHETTVDQIRDAIAPDFPE DQYEEYLKTFTKPSETPGFREAVYDTINSTPTEAVHMCIVLTT ALDSRILAPTLTNSLTPIKDMTLKEREQLLAAWRDSPIAAKRR LFRLISSLTLTTFTRLASDLHLRAIHYPGRDLREKAYETQVVD PFRYSFMEKPKFDGTELYLPDIDVIIGSGAGAGVMAHTLAN DGYKTLVLEKGKYFSNSELNFNDADGMKELYQGKCALTTT NQQMFILAGSTLGGGTTVNWSACLKTPFKVRKEWYDEFGLE FAADEAYDKAQDYVWKQMGASTEGITHSLANAVVVEGGK KLGYKSKEIEQNNGGHPDHPCGFCYLGCKYGIKQGSVNNWF RDAAAHGSKFMQQVRVVQILHNKGVAYGILCEDVETGVKF TISGPKKFVVSAGSLNTPTVLTNSGFKNKHIGKNLTLHPVSTV FGDFGRDVQADHFHKSIMTSLCYEVADLDGKGHGCRIETILN APFIQASLLPWRGSDEVRRDLLRYNNMVAMLLITRDTTSGSV SADPKKPDALIVDYDINKFDKNAILQAFLITSDMLYIEGAKRI LSPQAWVPIFESNKPKEQRTIKDKDYVEWRAKAAKIPFDTYG SAYGSAHQMST |
| SEQ ID NO: 12 | FAO-18(fatty alcohol oxidase activity) *C. Tropicalis* Nuc. Seq | atggctccatttttgccgaccaggtcgactacaaacacgtcgacacccttatgttattatgtgacg ggatcatccacgaaaccaccgtggacgaaatcaaagacgtcattgccctgacttccccgccga caaatacgaggagtacgtcaggacattcaccaaaccctcgaaacccagggttcagggaaac cgtctacaacaccgtcaacgcaacaccatgatgcaatccaccagttcattatcttgaccaatgt tttggatcaagggtcttggcaccagctttgaccaactcgttgactcctatcaaggacatgagcttg gaagaccgtgaaaagttgttagcctcgtggcgtgactcccctattgctgctaaaaggaagttgttc aggttggtttctacgcttaccttggtcacgttcacgagattggccaatgagttgcatttgaaagccat tcattatccaggaagagaagaccgtgaaaaggcttatgaaacccaggagattgaccctttaagt accagttttttggaaaaaccgaagttttacggcgctgagttgtacttgccagatattgatgtgatcatt attggatctggggccggtgctggtgtcgtggcccacactttgaccaacgacgcttcaagagttt ggttttggaaaagggcagatactttagcaactccgagttgaactttgatgacaaggacggggttc aagaattataccaaagtggaggtactttgaccaccgtcaaccagcagttgtttgttcttgctggttcc actttttggtggtggtaccactgtcaattggtcggcctgtcttaaaacgccattcaaggtgcgtaagg aatggtatgatgagtttggcgttgacttgctgccgatgaagcctacgacaaagcacaggattatg tttggcagcaaatgggagcttctaccgaaggcatcacccactctttggctaacgagattattattga aggtggcaagaaattaggttacaaggccaaggtattagaccaaaacgaggtggtcatcctcat cacagatgcggtttctgttatttgggttgtaagcacggtatcaagcagggtctgttaataactggtt tagagacgcagctgcccacggttctcagttcatgcaacaggttagagtttgcaaatccttaacaa gaagggcatcgcttatggtatcttgtgtgaggatgttgtaaccggtgccaagttcaccattactggc cccaaaaagtttgttgttgccgccggcgccttaaacactccatcgtgttggtcaactccggattca agaacaagaacatcggtaagaacttaacttttgcatccagtttctgtcgtgtttggtgattttggcaaa gacgttcaagcagatcacttccacaactccatcatgactgctctttgttcagaagccgctgatttag acggcaagggtcatggatgcagaattgaaaccatcttgaacgctccattcatccaggcttcattctt accatggagaggtagtaacgaggctagacgagacttgttgcgttacaacaacatggtggccatg ttacttcttagtcgtgataccaccagtggttccgtttcgtcccatccaactaaaccctgaagcattagtt |

TABLE 40-continued

| SEQ ID NO: | Description | Sequence |
|---|---|---|
| | | gtcgagtacgacgtgaacaagtttgacagaaactccatcttgcaggcattgttggtcactgctgac<br>ttgagtacattcaaggtgccaagagaatccttagtccccaaccatgggtgccaattttttgaatccg<br>acaagccaaaggataagagatcaatcaaggacgaggactatgtcgaatggagagccaaggttg<br>ccaagattccttttgacacctacggctcgccttatggttcggcgcatcaaatgtcacttgtcgtatgt<br>caggtaagggtcctaaatacggtgctgttgataccgatggtagattgtttgaatgttcgaatgatat<br>gttgctgacgctagtcttttgccaactgctagcggtgctaatcctatggtcaccaccatgactcttgc<br>aagacatgttgcgttaggtttggcagactccttgaagaccaaggccaagttgtag |
| SEQ ID NO: 13 | FAO-1 (fatty alcohol oxidase activity) C. Tropicalis A.A. Seq | MAPFLPDQVDYKHVDTLMLLCDGIIHETTVDEIKDVIAPDFP<br>ADKYEEYVRTFTKPSETPGFRETVYNTVNANTMDAIHQFIIL<br>TNVLGSRVLAPALTNSLTPIKDMSLEDREKLLASWRDSPIAA<br>KRKLFRLVSTLTLVTFTRLANELHLKAIHYPGREDREKAYET<br>QEIDPFKYQFLEKPKFYGAELYLPDIDVIIGSGAGAGVVAHT<br>LTNDGFKSLVLEKGRYFSNSELNFDDKDGVQELYQSGGTLT<br>TVNQQLFVLAGSTFGGGTTVNWSACLKTPFKVRKEWYDEF<br>GVDFAADEAYDKAQDYVWQQMGASTEGITHSLANEIIIEGG<br>KKLGYKAKVLDQNSGGHPHHRCGFCYLGCKHGIKQGSVNN<br>WFRDAAAHGSQFMQQVRVLQILNKKGIAYGILCEDVVTGA<br>KFTITGPKKFVVAAGALNTPSVLVNSGFKNKNIGKNLTLHPV<br>SVVFPGDFGKDVQADHFHNSIMTALCSEAADLDGKGHGCRIE<br>TILNAPFIQASFLPWRGSNEARRDLLRYNNMVAMLLLSRDTT<br>SGSVSSHPTKPEALVVEYDVNKFDRNSILQALLVTADLLYIQ<br>GAKRILSPQPWVPIFESDKPKDKRSIKDEDYVEWRAKVAKIP<br>FDTYGSPYGSAHQMSSCRMSGKGPKYGAVDTDGRLFECSN<br>VYVADASLLPTASGANPMVTTMTLARHVALGLADSLKTKA<br>KL |
| SEQ ID NO: 14 | cytochrome P450 A12 (CYP52A12) Nuc. Seq | atggccacacaagaaatcatcgattctgtacttccgtacttgaccaaatggtacactgtgattactg<br>cagcagtattagtcttccttatctccacaaacatcaagaactacgtcaaggcaaagaaattgaaat<br>gtgtcgatccaccatacttgaaggatgccggtctcactggtattctgtctttgatcgccgccatcaa<br>ggccaagaacgacggtagattggctaacttgccgatgaagttttcgacgagtaccaaaccac<br>accttctacttgtctgttgccggtgctttgaagattgtcatgactgttgacccagaaaacatcaaggc<br>tgtcttggccaccaattcactgactctccttgggtaccagacacgccacttgctcctttgttgg<br>gtgacggtatcttcaccttggacggagaaggttggaagcactccagagctatgttgagaccaca<br>gtttgctagagaccagattggacacgtttaaagccttggaaccacacatccaaatcatggctaagc<br>agatcaagttgaaccagggaaagactttcgatatccaagaattgttctttagatttaccgtcgacac<br>cgctactgagttcttgtttggtgaatccgttcactccttgtacgatgaaaaattgggcatcccaactc<br>caaacgaaatcccaggaagagaaaactttgccgctgctttcaacgtttcccaacactacttggcc<br>accagaagttactcccagacttttttactttttgaccaacccctaaggaattcagagactgtaacgca<br>aggtccaccacttggccaagtactttgtcaacaaggccttgaactttactcctgaagaactcgaag<br>agaaatccaagtccggttacgttttcttgtacgaattggttaagcaaaccagagatccaaggtctt<br>gcaagatcaattgttgaacattatggttgccggaagagacaccactgccggtttgttgtcctttgctt<br>tgttgaattggctagacacccagagatgtggtccaagttgagagaagaaatcgaagttaacttg<br>gtgttggtgaagactcccgcgttgaagaaattaccttcgaagccttgaagagatgtgaatacttga<br>aggctatccttaacgaaaccttgcgtatgtacccatccgtcttcctgtcaactttagaaccgccaccag<br>agacaccactttgccaagaggtggtggtgctaacggtaccgacccaatctacattcctaaaggct<br>ccactgttgcttacgttgtctacaagacccaccgtttggaagaatactacggtaaggacgctaacg<br>acttcagaccagaaagatggttgaaccatctactaagaagttgggctgggcttatgttccattcaa<br>cggtggtccaagagtctgcttgggtcaacaattcgccttgactgaagcttcttatgtgatcactaga<br>ttggcccagatgtttgaaactgtctcatctgatccaggtctcgaatacctccaccaaagtgtattca<br>cttgaccatgagtcacaacgatggtgtctttgtcaagatgtaa |
| SEQ ID NO: 15 | cytochrome P450 A13 (CYP52A13) Nuc. Seq | atgactgtacacgatattatcgccacatacttcaccaaatggtacgtgatagtaccactcgctttgat<br>tgcttatagagtcctcgactactctatggcagatacttgatgtacaagcttggtgctaaaccattttt<br>ccagaaacagacagacgctgtttcggattcaaagctccgcttgaattgttgaagaagaagagc<br>gacggtaccctcatagacttcacactccagcgtatccacgatctcgatcgtcccgatatccaact<br>ttcacattcccggtctttccatcaaccttgtcaataccctttgagccggagaacatcaaggccatctt<br>ggccactcagttcaacgatttctccttgggtaccagacactcgcacttctgctcctttgttgggtgatg<br>gtatctttacgttggatggcgccggctggaagcacagcagatctatgttgagaccacagtttgcca<br>gagaacagatttcccacgtcaagttgttggacgtccacacgttcaagtgttcttcaaacacgtcagaa<br>aggcacagggcaagacttttgacatccaggaattgtttttcagattgaccgtcgactccgccaccg<br>agttttgtttggtgaatccgttgagtcctgagagatgaatctatcggcatgtccatcaatgcgcttg<br>actttgacggcaaggctggctttgctgatgcttttaactattcgcagaattatttggcttcgagagcg<br>gttatgcaacaattgtactgggtgttgaacgggaaaagttaaggagtgcaacgctaaagtgca<br>caagtttgctgactactacgtcaacaaggctttggacttgacgcctgaacaattggaaaagcagg<br>atggttatgtgttttgtacgaattggtcaagcaaaccagagacaagcaagtgttgagagaccaatt<br>gttgaacatcatggttgctggtagagacaccaccgccggtttgttgtcgtttgttttctttgaattggc<br>cagaaacccagaagttaccaacaagttgagagaagaaattgaggacaagtttggactcggtga<br>gaatgctagtgttgaagacatttcctttgagtcgttgaagtcctgtgaatacttgaaggctgttctca<br>acgaaaccttgagattgtacccatccgtgccacagaatttcagagttgccaccaagaacactacc<br>ctcccaagaggtggtggtaaggacgggtgtctcctgttttggtgagaaagggtcagaccgttatt<br>tacggtgtctctacgcagcccacagaaaccagctgttacggtaaggacgctcttgagttctagacc<br>agagagatggttgagccagagacaaagaagcttggctgggccttcctcccattcaacggtggt<br>ccaagaatctgtttgggacagcagtttgccttgacagaagcttcgtatgtcactgtcaggttgctcc<br>aggagtttgcacacttgtctatggacccagacaccgaatatccacctaagaaaatgtcgcatttga<br>ccatgtcgcttttcgacggtgccaatattgagatgtattag |

TABLE 40-continued

| SEQ ID NO: | Description | Sequence |
| --- | --- | --- |
| SEQ ID NO: 16 | cytochrome P450 A14 (CYP52A14) Nuc. Seq | atgactgcacaggatattatcgccacatacatcaccaaatggtacgtgatagtaccactcgctttg<br>attgcttataggtcctcgactacttttacggcagatacttgatgtacaagcttggtgctaaaccgttt<br>ttccagaaacaaacagacggttattcggattcaaagctccacttgaattgttaaaaagaagagt<br>gacggtaccctcatagacttcactctcgagcgtatccaagcgctcaatcgtccagatatcccaact<br>tttacattcccaatcttttccatcaaccttatcagcacccttgagccggagaacatcaaggctatctt<br>ggccaccccagttcaacgatttctccttgggcaccagacactcgcactttgctccttgttgggcgat<br>ggtatcttaccttggacggtgccggctggaagcacagcagatctatgttgagaccacagtttgcc<br>agagaacagatttccacgtcaagttgttggagccacacatgcaggtgttcttcaagcacgtcag<br>aaaggcacagggcaagactttgacatccaagaattgtttttcagattgaccgtcgactccgccac<br>tgagttttttgtttggtgaatccgttgagtccttgagagatgaatctattgggatgtccatcaatgcact<br>tgactttgacggcaaggctggctttgctgatgcttttaactactcgcagaactatttggcttcgagag<br>cggttatgcaacaattgtactgggtgttgaacgggaaaaagtttaaggagtgcaacgctaaagtg<br>cacaagtttgctgactattacgtcagcaaggctttggacttgacacctgaacaattggaaaagcag<br>gatggttatgtgttcttgtacgagttggtcaagcaaaccagagacaggcaagtgttgagagacca<br>gttgttgaacatcatggttgccggtagagacaccaccgccggtttgttgtcgtttgttttctttgaatt<br>ggccagaaacccagaggtgaccaacaagttgagagaagaaatcgaggacaagtttggtcttgg<br>tgagaatgctcgtgttgaagacatttcctttgagtcgttgaagtcatgtgaatacttgaaggctgttct<br>caacgaaactttgagattgtacccatccgtgccacagaattcagagttgccaccaaaaacactac<br>ccttccaaggggaggtggtaaggacgggttatctcctgttttggtcagaaagggtcaaaccgttat<br>gtacggtgtctacgctgcccacagaaacccagctgtctacggtaaggacgcccttgagtttagac<br>cagagaggtggtttgagccagagacaaagaagcttggctgggccttccttccattcaacggtggt<br>ccaagaatttgcttgggacagcagtttgccttgacagaagcttcgtatgtcactgtcagattgctcc<br>aagagtttggacacttgtctatggaccccaacaccgaatatccacctaggaaaatgtcgcatttga<br>ccatgtcccttttcgacggtgccaacattgagatgtattag |
| SEQ ID NO: 17 | cytochrome P450 A15 (CYP52A15) Nuc. Seq | atgtcgtcttctccatcgtttgcccaagagggttctcgctaccactagtccttacatcgagtactttctt<br>gacaactacaccagatggtactacttcataccctttggtgcttattcgttgaactttataagtttgctcc<br>acacaaggtacttggaacgcaggttccacgccaagccactcggtaactttgtcagggaccctac<br>gtttggtatcgctactccgttgcttttgatctacttgaagtcgaaaggtacggtcatgaagtttgcttg<br>gggcctctggaacaacaagtacatcgtcagagacccaaagtacaagacaactgggcaggat<br>tgtttggcctcccattgattgaaaccatggaaccagagaacatcaaggctgtgttttggctactcagttc<br>aatgatttctcttttgggaaccagacacgattcttgtactccttgttgggtgacggtattttcaccttgg<br>acggtgctggctggaaacatagtagaactatgttgagaccacagtttgctagagaacaggtttctc<br>acgtcaagttgttggagccacacgttcaggtgttcttcaagcacgttagaaagcaccgcggtcaa<br>acgttcgacatccaagaattgttcttcaggttgaccgtcgactccgccaccgagttcttgttttggtg<br>agtctgctgaatccttgagggacgaatctattggattgaccccaaccaccaaggatttcgatggca<br>gaagagatttcgctgacgctttcaactattcgcagacttaccaggcctacagattttttgttgcaaca<br>aatgtactggatcttgaatggctcggaattcagaaagtcgattgctgtcgtgcacaagttgctgac<br>cactatgtgcaaaaggctttggagttgaccgacgacgacttgcagaaacaagacggctatgtgtt<br>cttgtacgagttggctaagcaaaccagagacccaaaggtcttgagagaccagttgttgaacatttt<br>tggttgccggtagagacacgaccgccggtttgttgtcatttgttttctacgagttgtcaagaaaccct<br>gaggtgtttgctaagttgagagaggaggtggaaaacagatttggactcggtgaagaagctcgtg<br>ttgaagagatctcgtttgagtccttgaagtcttgagtacttgaaggctgtcatcaatgaaaccttg<br>agattgtacccatccggttccacacaactttagagttgctaccagaaacactaccctcccaagagg<br>tggtggtgaagatggatactcgccaattgtcgtcaagaagggtcaagttgtcatgtacactgttattg<br>ctacccacagagacccaagtatctacggtgccgacgctgacgtcttcagaccagaaagatggttt<br>gaaccagaaactagaaagttgggctgggcatacgcttccattcaatggtggtccaagaatctgtttg<br>ggtcaacagtttgccttgaccgaagcttcatacgtcactgtcagattgctccaggagtttgcacact<br>tgtctatggacccagacaccgaatatccaccaaaattgcagaacaccttgaccttgtcgctctttga<br>tggtgctgatgttagaatgtactaa |
| SEQ ID NO: 18 | cytochrome P450 A16 (CYP52A16) Nuc. Seq | atgtcgtcttctccatcgtttgctcaggaggttctcgctaccactagtccttacatcgagtactttcttg<br>acaactacaccagatggtactacttcatcccttggtgcttattcgttgaacttcatcagcttgctcc<br>acacaaagtacttggaacgcaggttccacgccaagccgctcggtaacgtcgtgttggatcctac<br>gtttggtatcgctactccgttgatcttgatctacttaaagtcgaaaggtacagtcatgaagtttgcctg<br>gagcttctggaacaacaagtacattgtcaaagacccaaagtacaagacatctggccttagaattg<br>tcggcctcccattgattgaaaccatagacccagagaacatcaaagctgtgttggctactcagttca<br>cgatttctccttgggaactagacacgatttcttgtactccttgttgggcgatggtatttttaccttgga<br>cggtgctggctggaaacacagtagaactatgttgagaccacagtttgctagagaacaggtttccc<br>acgtcaagttgttggacacacgttcaggtgttcttcaagcacgttagaaaacaccgcggtcag<br>acttttgacatccaagaattgttcttcagattgaccgtcgactccgccaccgagtcttgttttggtga<br>gtctgctgaatccttgagagacgactctgttggtttgaccccaaccaccaaggatttcgaaggca<br>gaggagatttcgctgacgctttcaactactcgcagacttaccaggcctacagattttttgttgcaaca<br>aatgtactggattttgaatggcgcggaattcagaaagtcgattgccatcgtgcacaagttgctga<br>ccactatgtgcaaaaggcttggagttgaccgacgatgacttgcagaaacaagacggctatgtgt<br>tcttgtacgagttggctaagcaaactagagacccaaaggtcttgagagaccagttgttgaacatttt<br>tggttgccggtagagacacgaccgccggtttgttgtcgtttgtgttctacgagttgtcgagaaaccc<br>tgaagtgtttgccaagttgagagaggaggtggaaaacagatttggactcggcgaagaggctcgt<br>gttgaagagatctcttttgagtccttgaagtcctgtgagtacttgaaggctgtcatcaatgaagcctt<br>gagattgtacccatctgttccacacaacttcagagttgccaccagaaacactaccttccaagag<br>gcgttggaagacggatgctcgccaattgttgtcaagaagggtcaagttgtcatgtacactgtc<br>attggtacccacagagacccaagtatctacggtgccgacgccgacgtcttcagaccagaaagat<br>ggttcgagccagaaactagaaagttgggctgggcatatgttccattcaatggtggtccaagaatct<br>gtttgggtcagcagtttgccttgactgaagcttcatacgtcactgtcagattgctccaagagtttgga<br>aacttgtccctggatccaaacgctgagtacccaccaaaattgcagaacaccttgaccttgtcactc<br>tttgatggtgctgacgttagaatgttctaa |

TABLE 40-continued

| SEQ ID NO: | Description | Sequence |
| --- | --- | --- |
| SEQ ID NO: 19 | cytochrome P450 A17 (CYP52A17) Nuc. Seq | atgattgaacaactcctagaatattggtatgtcgttgtgccagtgttgtacatcatcaaacaactcctt gcatacacaaagactcgcgtcttgatgaaaaagttgggtgctgctccagtcacaaacaagttgta cgacaacgctttcggtatcgtcaatggatggaaggctctccagttcaagaaagagggcagggct caagagtacaacgattacaagtttgaccactccaagaacccaagcgtgggcacctacgtcagta ttcttttcggcaccaggatcgtcgtgaccaaagatccagagaatatcaaagctattttggcaaccc agtttggtgattttttctttgggcaagaggcacactcttttaagccttttgttaggtgatgggatcttcac attggacggcgaaggctggaagcacagcagagccatgttgagaccacagtttgccagagaac aagttgctcatgtgacgtcgttggaaccacacttccagttgttgaagaagcatattcttaagcacaa gggtgaatactttgatatccaggaattgttctttagatttaccgttgattcggccacggagttcttattt ggtgagtccgtgcactccttaaaggacgaatctattggtatcaaccaagacgatatagattttgctg gtagaaaggactttgctgagtcgttcaacaaagcccaggaatacttggctattagaaccttggtgc agacgttctactggttggtcaacaacaaggagtttagagactgtaccaagctggtgcacaagttc accaactactatgttcagaaagctttggatgctagcccagaagagcttgaaaagcaaagtgggta tgtgttcttgtacgagcttgtcaagcagacaagagaccccaatgtgttgcgtgaccagtctttgaac atcttgttggccggaagagacaccactgctgggttgttgtcgtttgctgtctcttgagttggccagac acccagagatctgggccaagttgagagaggaaattgaacaacagtttggtcttggagaagactc tcgtgttgaagagattacctttgagagcttgaagagatgtgagtacttgaaagcgttccttaatgaa accttgcgtatttacccaagtgtcccaagaaaacttcagaatcgccaccaagaacacgacattgcc aaggggcggtggttcagacggtacctcgccaatcttgatccaaaagggagaagctgtgtcgtat ggtatcaactctactcatttggaccctgtctattacgccctgatgctgctgagttcagaccagaga gatggtttgagccatcaaccaaaaagctcggctgggcttacttgccattcaacggtggtccaaga atctgtttgggtcagcagtttgccttgacggaagctggctatgtgttggttagattggtgcaagagtt ctcccacgttaggctggaccagacgaggtgtaccgccaaagaggttgaccaacttgaccatg tgtttgcaggatggtgctattgtcaagtttgactag |
| SEQ ID NO: 20 | cytochrome P450 A18 (CYP52A18) Nuc. Seq | atgattgaacaaatcctagaatattggtatattgttgtgcctgtgttgtacatcatcaaacaactcatt gcctacacaacaagactcgcgtccttgatgaaacagttgggtgctgctccaatcacaaaccagttgta cgacaacgttttcggtatcgtcaacggatggaaggctctccagttcaagaaagagggcagagct caagagtacaacgatcacaagtttgacagctccaagaacccaagcgtcggcacctatgtcagta ttcttttttggcaccaagattgtcgtgaccaaggatccagagaatatcaaagctattttggcaacca gtttggcgattttctttgggcaagagacacgctcttttttaaacctttgttaggtgatgggatcttcacc ttggacggcgaaggctggaagcatagcagatccatgttaagacacagtttgccagagaacaa gttgctcatgtgacgtcgttggaaccacacttccagttgttgaagaagcatatccttaaacacaag ggtgagtactttgatatccaggaattgttctttagatttactgtcgactcggccacggagttcttatttg gtgagtccgtgcactccttaaaggacgaaactatcggtatcaaccaagacgatatagattttgctg gtagaaaggactttgctgagtcgttcaacaaagcccaggagtatttgtctattagaattttggtgca gaccttctactggttgatcaacaacaaggagtttagagactgtaccaagctggtgcacaagtttac caactactatgttcagaaagctttggatgctaccccagaagaactttgaaaagcaaagcgggtatg tgttcttgtatgagcttgtcaagcagacgagagaccccaaggtgttgcgtgaccagtctttgaaca tcttgttggcaggaagagacaccactgctgggttgttgtcctttgctgtgtttgagttggccagaaa cccacacatctgggccaagttgagagaggaaattgaacagcagtttggtcttggagaagactctc gtgttgaagagattacctttgagagcttgaagagatgtgagtacttgaaagcgttccttaacgaaa ccttgcgtgtttaccaagtgtcccaagaaacttcagaatcgccaccaagaatacaacattgccaa ggggtggtggttccagacggtacccagccaatcttgatccaaaagggagaaggtgtgtcgtatg gtatcaactctacccacttagatcctgtctattatggccctgatgctgctgagttcagaccagagag atggtttgagccatcaaccagaaagctcggctgggcttacttgccattcaacggtgggccacgaa tctgtttgggtcagcagtttgccttgaccgaagctggttacgttttggtcagattggtgcaagagttc tcccacattaggctggacccagatgaagtgtatccaccaaagaggttgaccaacttgaccatgtg tttgcaggatggtgctattgtcaagtttgactag |
| SEQ ID NO: 21 | cytochrome P450 A19 (CYP52A19) Nuc. Seq | atgctcgatcagatcttacattactggtacattgtcttgccattgttggccattatcaaccagatcgtg gctcatgtcaggaccaattatttgatgaagaaatttgggtgctaagccattcacacacgtccaacgt gacgggtggtgggcttcaaattcggccgtgaattcctcaaagcaaaaagtgctgggagactgg ttgatttaatcatctcccgtttccacgataatgaggacactttctccagctatgcttttggcaaccatgt ggtgttcaccagggaccccgagaatatcaaggcgcttttggcaacccagtttggtgatttttcattg ggcagcagggtcaagttcttcaaaccattattgggtacggtatcttcacattggacgccgaagg ctggaagcacagcagagccatgttgagaccacagtttgccagagaacaagttgctcatgtgacg tcgttggaaccacacttccagttgttgaagaagcatatccttaaacacaaggtgagtactttgata tccaggaattgttctttagatttactgtcgactcggccacggagttcttatttggtgagtccgtgcact ccttaaaggacgaggaaattggctacgacacgaaagacatgtctgaagaaagacgcagatttgc cgacgcgttcaacaagtcgcaagtctacgtggccaccagagttgctttacagaacttgtactggtt ggtcaacaacaaagagttcaaggagtgcaatgacattgtccacaagtttaccaactactatgttca gaaagccttggatgctaccccagaggaacttgaaaagcaaggcgggtatgtgttcttgtatgagc ttgtcaagcagacgagagaccccaaggtgttgcgtgaccagtctttgaacatcttgttggcagga agagacaccactgctgggttgttgtcctttgctgtgtttgagttggccagaaacccacacatctgg gccaagttgagagaggaaattgaacagcagtttggtcttggagaagactctcgtgttgaagagat tacctttgagagcttgaagagatgtgagtacttgaaggccgtgttgaacgaaactttgagattaca cccaagtgtcccaagaaacgcaagatttgcgattaaagacacgactttaccaagaggcggtggc cccaacggcaaggatcctatcttgatcaggaaggtgaggtgggtgcagtactccatctcggcaa ctcagacaaatcctgcttattatgcgccgatgctgctgattttagaccggaaagatggtttgaacc atcaactagaaacttgggatgggctttcttgccattcaacggtggtccaagaatctgtttgggacaa cagtttgctttgactgaagccggttacgttttggttagacttgttcaggagtttccaaacttgtcacaa gaccccgaaaccaagtacccaccacctagattggcacacttgacgatgtgcttgtttgacggtgc acacgtcaagatgtcatag |

TABLE 40-continued

| SEQ ID NO: | Description | Sequence |
|---|---|---|
| SEQ ID NO: 22 | cytochrome P450 A20 (CYP52A20) Nuc. Seq | atgctcgaccagatcttccattactggtacattgtcttgccattgttggtcattatcaagcagatcgtg gctcatgccaggaccaattatttgatgaagaagtgggcgctaagccattcacacatgtccaacta gacgggtggtttggcttcaaatttggccgtgaattcctcaaagctaaaagtgctggggaggcaggtt gatttaatcatctcccgtttccacgataatgaggacacttctccagctatgcttttggcaaccatgtg gtgttcaccagggaccccgagaatatcaaggcgctttggcaacccagtttggtgatttttcattgg gaagcagggtcaaattcttcaaaccattgttggggtacggtatcttcaccttggacggcgaaggct ggaagcacagcagagccatgttgagaccacagtttgccagagagcaagttgctcatgtgacgtc gttggaaccacatttccagttgttgaagaagcatattcttaagcacaagggtgaatactttgatatcc aggaattgttcttttagatttaccgttgattcagcgacggagttcttatttggtgagtccgtgcactcctt aagggacgaggaaattggctacgatacgaaggacatggctgaagaaagacgcaaatttgccg acgcgttcaacaagtcgcaagtctatttgtccaccagagttgctttacagacattgtactggttggtc aacaacaaagagttcaaggagtgcaacgacattgtccacaagttcaccaactactatgacagaa agccaggatgctaccccagaggaacttgaaaaacaaggcgggtatgtgactttgtacgagcttg ccaagcagacgaaagaccccaatgtgagcgtgaccagtattgaacatcttgaggctggaagg gacaccactgctgggagagtcattgctgtgatgagaggccaggaacccacacatctgggcc aagttgagagaggaaattgaatcacactagggctgggtgaggactctcgtgagaagagattac ctttgagagcttgaagagtgtgagtacttgaaggccgtgttgaacgaaacgttgagattacaccc aagtgtcccaagaaacgcaagatttgcgattaaagacacgactttaccaagaggcggtggcccc aacggcaaggatcctatcttgatcagaaagaatgaggtggtgcaatactccatctcggcaactca gacaaatcctgcttattatggcgccgatgctgctgatatagaccgaaagatggatgagccatca actagaaacttgggatgggcttacttgccattcaaccgtggtccaagaatctgatgggacaaca gatgattgaccgaagccggttacgatttggttagacttgacaggaattccctagatgtcacagg accccgaaactgagtacccaccacctagattggcacacttgacgatgtgcttgatgacggggca tacgtcaagatgcaatag |
| SEQ ID NO: 23 | cytochrome P450 D2 (CYP52 D2) Nuc. Seq | atggctatatctagtttgctatcgtgggatgtgatctgtgtcgtcttcatttgcgtttgtgtttatttcgg gtatgaatattgttatactaaatacttgatgcacaaacatggcgctcgagaaatcgagaatgtgatc aacgatgggttctttgggttccgcttacctttgctactcatgcgagccagcaatgagggccgactt atcgagttcagtgtcaagagattcgagtcggcgccacatccacagaacaagacattggtcaacc gggcattgagcgttcctgtgatactcaccaaggaccgatgtgaatatcaaagcgatgctatcgacc cagtttgatgacttttccctgggttgagactacaccagtttgcgccgttgttggggaaaggcatctt tacttggacggccagagtggaagcagagccgatctatgttgcgtccgcaatttgccaaagatc gggtttctcatatcctggatctagaaccgcattttgtgttgcttcggaagcacattgatggccacaat ggagactacttcgacatccaggagctctacttccggttctcgatggatgtgcgacggggttttg tttggcgagtctgtggggtcgttgaaagacgaagatgcgaggttcctgaagcattcaatgagtc gcagaagtatttggcaactagggcaacgttgcacgagttgtacttttctttgtgacgggtttaggttc gccagtacaacaaggttgtgcgaaagttctgcagccagtgtgtccacaaggcgttagatgttgca ccggaagacaccagcgagtacgtgtttctccgcgagttggtcaaacactactcgagatcccgttgt tttacaagaccaagcgttgaacgtcttgcttgctggacgcgacaccaccgcgtcgttatatcgtttt gcaacatttgagctagccccggaatgaccacatgtggaggaagctacgagaggaggttatcctga cgatgggaccgtccagtgatgaaataaccgtggccgggttgaagagttgccgttacctcaaagc aatcctaaacgaaactcttcgactatcccaagtgtgcctaggaacgcgagatttgctacgagga atacgacgcttcctcgtggcggaggtccagatggatcgtttccgattttgataagaaagggccag ccagtgggtatttcatttgtgctacacacttgaatgagaaggtatatgggaatgatagccatgtgt ttcgaccggagagatgggctgcgttagagggcaagagtttgggctggtcgtatcttccattcaac ggcggcccgagaagctgccttggtcagcagtttgcaatccttgaagcttcgtatgttttggctcgat tgacacagtgctacacgacgatacagctagaactaccgagtacccaccaaagaaactcgttcat ctcacgatgagtcttctcaacggggtgtacatccgaactagaacttga |
| SEQ ID NO: 24 | cytochrome P450:NADPH P450 reductase (Bacillus megaterium) nucleotide Nuc. Seq | atgacaattaaagaaatgcctcagccaaaaacgtttggagagcttaaaaatttaccgttattaaaca cagataaaccggttcaagctttgatgaaaattgcggatgaattaggagaaatctttaaattcgagg cgcctggtcgtgtaacgcgctacttatcaagtcagcgtctaattaaagaagcatgcgatgaatcac gctttgataaaaacttaagtcaagcgcttaaatttgtacgtgattttgcaggagacgggttatttaca agctggacgcatgaaaaaaatttggaaaaagcgcataatatcttacttccaagcttcagtcagca ggcaatgaaaggctatcatgcgatgatggtcgatatcgcgtgcagcgttgttcaaagtgggagc gtctaaatgcagatgagcatattgaagtaccggaagacatgacacgtttaaccgcttgatacaattg gtctttgcggcttaactatcgctttaacagctttaccgagatcagcctcatccatttattacaagtat ggtccgtgcactggatgaagcaatgaacaagctgcagcgagcaaatccagacgacccagctta tgatgaaaacaaggcgccagtttcaagaagatatcaaggtgatgaacgacctagtagataaaatta ttgcagatcgcaaagcaagcggtgaacaaagcgatgatttattaacgcatatgctaaacggaaaa gatccagaaacgggtgagccgcttgatgacgagaacattcgctatcaaattattacattcttaattg cgggacacgaaacaacaagtggtcttttatcatttgcgctgtatttcttagtgaaaaatccacatgta ttacaaaaagcagcagaagaagcagcacgagttctagtagatccttgttccaagctacaaacaag tcaaacagcttaaatatgtcggcatggtcttaaacgaagcgctgcgtttatgccaactgctcctg cgttttcctatatgcaaaagaagatcggtgcttggaggagaatatcctttagaaaaaggcgac gaactaatggttctgattcctcagcttcaccgtgataaaacaattgggggagacgatgtggaagag ttccgtccagagcgttttgaaaatccaagtgcgattccgcagcatgcgtttaaacgcttggaaac ggtcagcgtcgtgtatcggtcagcagttcgctcttcatgaagcaacgctggtacttggtatgatg ctaaaacacttttgactttgaagatcatacaaactacgagctggatattaaagaaactttaacgttaaa acctgaaggctttgtggtaaaagcaaatcgaaaaaaattccgcttggcggtattccttcacctag cactgaacagtctgctaaaaaagtacgcaaaaaggcagaaaacgctcataatacgcgcgctt gtgctatacggttcaaatatgggaacagctgaaggaacggcgcgttgatttagcagatattgcaat gagcaaaggatttgcaccgcaggtcgcaacgcttgattcacacgccggaaatcttccgcgcgaa ggagctgtattaattgtaacggcgtcttataacggtcatccgcctgataacgcaaagcaatttgtcg actggttagaccaagcgtctgctgatgaagtaaaaggcgttcgctactccgtatttggatgcggc gataaaaactgggctactacgtatcaaaaagtgcctgcttttatcgatgaaacgcttgccgctaaa |

TABLE 40-continued

| SEQ ID NO: | Description | Sequence |
|---|---|---|
| | | ggggcagaaaacatcgctgaccgcggtgaagcagatgcaagcgacgactttgaaggcacata<br>tgaagaatggcgtgaacatatgtggagtgacgtagcagcctactttaacctcgacattgaaaaca<br>gtgaagataataaatctactctttcacttcaatttgtcgacagcgccgcggatatgccgcttgcgaa<br>aatgcacggtgcgttttcaacgaacgtcgtagcaagcaaagaacttcaacagccaggcagtgca<br>cgaagcacgcgacatcttgaaattgaacttccaaaagaagcttcttatcaagaaggagatcattta<br>ggtgttattcctcgcaactatgaaggaatagtaaaccgtgtaacagcaaggttcggcctagatgc<br>atcacagcaaatccgtctggaagcagaagaagaaaaattagctcatttgccactcgctaaaacag<br>tatccgtagaagagcttctgcaatacgtggagcttcaagatcctgttacgcgcacgcagcttcgc<br>gcaatggctgctaaaacggtctgcccgccgcataaagtagagcttgaagccttgcttgaaaagc<br>aagcctacaaagaacaagtgctggcaaaacgtttaacaatgcttgaactgcttgaaaaatacccg<br>gcgtgtgaaatgaaattcagcgaatttatcgcccttctgccaagcatacgcccgcgctattactcg<br>atttcttcatcacctcgtgtcgatgaaaaacaagcaagcatcacggtcagcgttgtctcaggagaa<br>gcgtggagcggatatggagaatataaaggaattgcgtcgaactatcttgccgagctgcaagaag<br>gagatacgattacgtgctttatttccacaaccgcagtcagaatttacgctgccaaaagaccctgaaa<br>cgccgcttatcatggtcggaccgggaacaggcgtcgcgccgtttagaggctttgtgcaggcgc<br>gcaaacagctaaaagaacaaggacagtcacttggagaagcacatttatacttcggctgccgttca<br>cctcatgaagactatctgtatcaagaagagcttgaaaacgcccaaagcgaaggcatcattacgct<br>tcataccgcttttctcgcatgccaaatcagccgaaacatacgttcagcacgtaatggaacaaga<br>cggcaagaaattgattgaacttcttgatcaaggagcgcacttctatatttgcgggagacggaagcc<br>aaatggcacctgccgttgaagcaacgcttatgaaagctatgctgacgttcaccaagtgagtgaa<br>gcagacgctcgcttatggctgcagcagctagaagaaaaaggccgatacgcaaaagacgtgtg<br>ggctgggtaa |
| SEQ ID NO: 25 | NADPH cytochrome P450 reductase, CPR (Candida strain ATCC750) Nuc. Seq | atggcattagataagttagatttatatgttattataacattggtggttgcaattgcagcttatttgcaaa<br>gaatcagtttcttgaccaacaacaagataccggggttccttaatactgatagtggagatggtaattca<br>agagatatcttacaagctttgaagaagaacaataaaaatacgttattattatttggatcccaaacag<br>gtacagcagaagattatgccaacaaattgtcaaggagaattgcattcaagatttggtttgaaaaccat<br>ggttgctgatttcgctgattatgatttcgaaaacttcggagatattactgaagatatcttggttttcttta<br>ttgttgctacttatggtgaaggtgaaccaaccgataatgctgacgaatttcacacttggttgactga<br>agaagctgacaccttgagtactttgaaatatactgtttttggtttgggtaattcaacttatgaattcttc<br>aatgctattggtagaaaatttgacagattgttgggagaaaaggtggtgacagattgtctgaatac<br>ggtgaaggtgacgatggtactggtactttagatgaagatttcttggcctggaaggataacgtgtttg<br>attccttaaagaatgatttgaattttgaagaaaaagagttgaaatacgaaccaaatgttaaattgact<br>gaaagagatgatttatctggcaatgatccagatgtctccttgggtgaaccaaatgtcaaatacatta<br>aatctgaaggtgttgacttaactaaaggtccatttgtactcatactcatccatttttggctagaattgttaa<br>aactaaagaattgttttacttctgaagacagacattgtgttcatgttgaatttgatatttctgaatcaaac<br>ttgaaatataccaccggtgatcatcttgcaatctggccatctaactctgatgaaaacattaagcaatt<br>tgccaaatgttttggtttagaagacaaacttgatactgttattgaattgaaagctttggattccacttat<br>tccatcccattccctaatccaatcacttatgggtgttattgaacaccattggaaatttcaggtcct<br>gtttctagacaattttttcttatctattgctggatttgcccctgatgaagaaactaaaaagtcatttacta<br>gaattggtggtgataagcaagaatttgctagtaaagtcacccgtagaaaattcaacattgccgatg<br>ctttattatttgcttccaacaacagaccatggtccgatgttccattcgaattccttattgaaaatgtcca<br>acacttaactcctcgttattactccattctttcttcctcattaagtgaaaagcaaaccattaatgttactg<br>ctgttgttgaagccgaagaagaagctgatggaagaccagttactggtgttgtcaccaacttgttga<br>gaatattgaaattgaacaaaacaaaactggtgaaacccccaatggttcattatgatttgaatggtcc<br>aagaggcaaattagcaagttcagattgccagttcacgttagaagatctaatttcaaattaccaaag<br>aatagcactaccccagttattttgattggtccaggtacgggtgttgcaccattgagaggttttgttag<br>agaaagagttcaacaagttaaaaatggtgtaatgttggtaagactgtattgttttatggatgtagaa<br>attccgaacaagattcttgtacaaacaagaatggagtgaatatgcctcagtatgggagaaaattt<br>cgaaatgtttaatgccttctcaagacaagatccaactaagaaagtttatgttcaagataagattttag<br>aaaatagtgctcttgttgatgagttattatctagtggacaattatttttatgtttgtggtgatgccagtag<br>aatggctagagatgttcaagctgcaattgccaagattgttgccaaaagtagagatatccacgaag<br>ataaagctgctgaattggttaaatcttggaaagttcaaaatagataccaagaagatgtctggtaa |
| SEQ ID NO: 26 | NADPH cytochrome P450 reductase A, CPRA (Candida strain ATCC20336) Nuc. Seq | atggctttagacaagttagatttgtatgtcatcataacattggtggtcgctgtagccgcctatttgct<br>aagaaccagttcctgtcagccccaggacaccgggttcctcaacacggacagcggaagcaac<br>tccagagacgtcttgctgacattgaagaagaataataaaaacacgttgagttgtttgggtcccaga<br>cgggtacggcagaagattacgccaacaaattgtccagagaattgcactccagatttggcttgaaa<br>acgatggttgcagatttcgctgattacgattgggataacttcggagatatcaccgaagacatcttg<br>gtgttttcattgttgccacctatggtgagggtgaacctaccgataatgccgacgagttccacacct<br>ggttgactgaagaagctgacacttgagtacctgaaatacaccgtgtcggggtttgggtaactcca<br>cgtacgagttcttcaatgccattggtagaaagtttgacagattgttgagcgagaaaggtggtgaca<br>ggtttgctgaatacgctgaaggtgatgacggtactggcaccttggacgaagatttcatggcctgg<br>aaggacaatgtctttgacgccttgaaagatgattttgaagaaaaggaattgaagtacgaa<br>ccaaacgtgaaattgactgagagagacgacttgtctgctgctgactcccaagtttccttgggtgag<br>ccaaacaagaagtacatcaactccgagggcatcgacttgaccaaggggtccattcgaccacacc<br>cacccatacttggccagaatcaccgagacgagagagttgttcagctccaaggacagacactgta<br>tccacgttgaatttgacatttctgaatcgaacttgaaatacaccaccggtgaccatctagctatctgg<br>ccatccaactccgacgaaaacattaagcaatttgccaagtgtttcggattggaagataaactcgac<br>actgttattgaattgaaggcgttggactccacttacaccatcccattcccaacccaattacctacg<br>gtgctgtcattagacaccatttagaaatctccggtccagtctcgagacaattcttttttgtcaattgctg<br>ggtgctcctgatgaagaaacaaagaaggctttaccagacttggtgtgatgcaagcaagaattc<br>gccgccaaggtcacccgcagaaagttcaacattgccgatgcctcgttgtatattccctccaacaacgct<br>ccatggtccgatgttccttttgaattccttattgaaaacgttccacacttgactccacgttactactcc<br>atttcgtcttcgtcattgagtgaaaagcaactcatcaacgttactgcagttgttgaagccgaagaag<br>aagctgatggcagaccagtcactggtgttgtcaccaacttgttgaagaacgttgaaattgtgcaaa<br>acaagactggcgaaaagccacttgtccactacgatttgagcggcccaagaggcaagttcaaca</td> |

TABLE 40-continued

| SEQ ID NO: | Description | Sequence |
|---|---|---|
| | | agttcaagttgccagtgcatgtgagaagatccaactttaagttgccaaagaactccaccaccca<br>gttatcttgattggtccaggtactggtgttgcccattgagaggttttgtcagagaaagagttcaac<br>aagtcaagaatggtgtcaatgttggcaagactttgttgttttatggttgcagaaactccaacgagga<br>cttttttgtacaagcaagaatgggccgagtacgcttctgttttgggtgaaaactttgagatgttcaatg<br>ccttctccagacaagacccatccaagaaggtttacgtccaggataagattttagaaaacagccaa<br>cttgtgcacgagttgttgactgaaggtgccattatctacgtctgtggtgatgccagtagaatggcta<br>gagacgtgcagaccacaattccaagattgttgctaaaagcagagaaattagtgaagacaaggc<br>tgctgaattggtcaagtcctggaaggtccaaaatagataccaagaagatgtttggtag |
| SEQ ID NO: 27 | NADPH cytochrome P450 reductase B, CPRB (Candida strain ATCC20336) Nuc. Seq | atggcttagacaagttagatttgtatgtcatcataacattggtggtcgctgtggccgcctattttgct<br>aagaaccagttccttgatcagcccaggacaccgggttcctcaacacggacagcggaagcaac<br>tccagagacgtcttgctgacattgaagaagaataataaaaacacgttgagttgtttgggtcccaga<br>ccggtacggcagaagattacgccaacaaattgtcaagagaattgcactccagatttggcttgaaa<br>accatggttgcagatttcgctgattacgattgggataacttcgggagatatcaccgaagatatcttgg<br>tgttttttcatcgttgccacctacggtgagggtgaacctaccgacaatgccgacgagttccacacct<br>ggttgactgaagaagctgacactttgagtactttgagatataccgtgtcgggttgggtaactccac<br>ctacgagttcttcaatgctattggtagaaagtttgacagattgttgagtgagaaaggtggtgacaga<br>tttgctgaatatgctgaaggtgacgacggcactggcacctttggacgaagatttcatggcctggaa<br>ggataatgtctttgacgccttgaagaatgacttgaactttgaagaaaaggaattgaagtacgaacc<br>aaacgtgaaattgactgagagagatgacttgtctgctgccgactccaagtttccttgggtgagcc<br>aaacaagaagtacatcaactccgagggcatcgacttgaccaagggtccattcgaccacaccca<br>cccatacttggccaggatcaccgaaccagagagttgacagctcaaggaaagacactgtattc<br>acgttgaatttgacatttctgaatcgaacttgaaatacaccaccggtgaccatctagccatctggcc<br>atccaactccgacgaaaacatcaagcaatttgccaagtgatcggattggaagataaactcgaca<br>ctgttattgaattgaaggcattggactccacttacaccattccattcccaactccaattacttacggtg<br>ctgtcattagacaccattttagaaatctccggtccagtctcgagacaattcatagtcgattgctgggt<br>ttgctcctgatgaagaaacaaagaagactacaccagacttggtggtgacaaacaagaattcgcc<br>accaaggttaccgcagaaagtcaacattgccgatgccagttatattcctccaacaacactccat<br>ggtccgatgaccattgagaccttattgaaaacatccaacacttgactccacgttactactccatttc<br>acttcgtcgttgagtgaaaaacaactcatcaatgttactgcagtcgttgaggccgaagaagagc<br>cgatggcagaccagtcactggtgagttaccaacattgaagaacaatgaaattgcgcaaaacaa<br>gactggcgaaaagccacttgacactacgatttgagcggcccaagaggcaagttcaacaagttc<br>aagagccagtgcacgtgagaagatccaactttaagagccaaagaactccaccaccccagttat<br>cttgattggtccaggtactggtgttgcccattgagaggtttcgttagagaaagagttcaacaagtc<br>aagaatggtgtcaatgttggcaagactttgttgttttatggttgcagaaactccaacgaggactttt<br>gtacaagcaagaatgggccgagtacgcactgattgggtgaaaactagagatgacaatgcatc<br>tctagacaagacccatccaagaaggatacgtccaggataagatatagaaaacagccaacttgtg<br>cacgaattgagaccgaaggtgccattatctacgtctgtggtacgccagtagaatggccagaga<br>cgtccagaccacgatctccaagattgttgccaaaagcagagaaatcagtgaagacaaggccgc<br>tgaattggtcaagtcctggaaagtccaaaatagataccaagaagatgtttggtag |
| SEQ ID NO: 28 | cytochrome P450:NADPH P450 reductase (Bacillus megaterium) amino acid [P450 activity shown in italics, P450 reductase activity shown in normal font] A.A. Seq | *mtikempqpktfgelknlplintdkpvgalmkiadelgeifkfeapgrvtrylssqrlikeacde srfdknisqalkfvrdfagdglftswtheknwkkahnillpsfsqqamkgyhammvdiavql vqkwerinadehievpedmtritldtiglegfnyrfnsfyrdqphpfitsmvrasdeamnksq ranpddpaydenkrqfqedikvmndlvdkiiadrkasgeqsddlithmlngkdpetgepld deniryqiitfliaghettsgllsfasyfivknphylqkaaeeaarvlvdpvpsyqkvkqlkyvg mvineasrlwptapafslyakedtvlggeyplekgdelmvsipqlhrdktiwgddveefrper fenpsaipqhafkpfgngqracigqqfalheatsvignmilkhfdfedhtnyesdiketh lkpe gfvvkakskkiplggipspsteqsakkvrkkaenahntpslvlygsnmgtaegtardladiam skgfapqvaddshagnlpregavlivtasynghppdnakqfvdwldqasadevkgvrysv fgcgdknwattyqkvpafidetlaakgaeniadrgeadasddfegtyeewrehmwsdvaa yfnldiensednkstlslqfvdsaadmplakmhgafstnvvaskelqqpgsarstrhleielpk easyqegdhlgviprnyegivnrvtarfgldasqqirseaeeeklahlplaktvsveelsqyvel qdpvtrtqlramaaktvcpphkveleallekqaykeqvsakrltmlesleky pacemkfsefi alspsirpryysissssprvdekqasitvsvvsgeawsgygeykgiasnylaesqegdtitcfist pqseftspkdpetplimvgpgtgvapfrgfvqarkqlkeqgqslgeahlyfgcrsphedysy qeelenaqsegiitlhtafsrmpnqpktyvqhvmeqdgkklielldqgahfyicgdgsqma paveatlmksyadvhqvseadarlwsqqleekgryakdvwag* |
| SEQ ID NO: 29 | acyl CoA oxidase, PDX4 (Candida strain ATCC20336) nucleotide | ATGACTTTTACAAAGAAAAACGTTAGTGTATCACAAGGTC<br>CTGACCCTAGATCATCCATCCAAAAGGAAAGAGACAGCTC<br>CAAATGGAACCCTCAACAAATGAACTACTTCTTGGAAGGC<br>TCCGTCGAAAGAAGTGAGTTGATGAAGGCTTTGGCCCAAC<br>AAATGGAAAGAGACCCAATCTTGTTCACAGACGGCTCCTA<br>CTACGACTTGACCAAGGACCAACAAAGAGAATTGACCGC<br>CGTCAAGATCAACAGAATCGCCAGATACAGAGAACAAGA<br>ATCCATCGACACTTTCAACAAGAGATTGTCCTTGATTGGT<br>ATCTTTGACCCACAGGTCGGTACCAGAATTGGTGTCAACC<br>TCGGTTTGTTCCTTTCTTGTATCAGAGGTAACGGTACCACT<br>TCCCAATTGAACTACTGGGCTAACGAAAAGGAAACCGCTG<br>ACGTTAAAGGTATCTACGGTTGTTTCGGTATGACCGAATT<br>GGCCCACGGTTCAAACGTTGCTGGTTTGGAAACCACCGCC<br>ACATTTGACAAGGAATCTGACGAGTTTGTCATCAACACCC<br>CACACATTGGTGCCACCAAGTGGTGGATTGGTGGTGCTGC<br>TCACTCCGCCACCCACTGTTCTGTCTACGCCAGATTGATTG<br>TTGACGGTCAAGATTACGGTGTCAAGACTTTTGTTGTCCC<br>ATTGAGAGACTCCAACCACGACCTCATGCCAGGTGTCACT |

TABLE 40-continued

| SEQ ID NO: | Description | Sequence |
|---|---|---|
| | | GTTGGTGACATTGGTGCCAAGATGGGTAGAGATGGTATCG<br>ATAACGGTTGGATCCAATTCTCCAACGTCAGAATCCCAAG<br>ATTCTTTATGTTGCAAAAGTTCTGTAAGGTTTCTGCTGAAG<br>GTGAAGTCACCTTGCCACCTTTGGAACAATTGTCTTACTCC<br>GCCTTGTTGGGTGGTAGAGTCATGATGGTTTTGGACTCCT<br>ACAGAATGTTGGCTAGAATGTCCACCATTGCCTTGAGATA<br>CGCCATTGGTAGAAGACAATTCAAGGGTGACAATGTCGAT<br>CCAAAAGATCCAAACGCTTTGGAAACCCAATTGATAGATT<br>ACCCCATTGCACCAAAAGAGATTGTTCCCATACTTGGCTGC<br>TGCCTACGTCATCTCCGCTGGTGCCCTCAAGGTTGAAGAC<br>ACCATCCATAACACCTTGGCTGAATTGGACGCTGCCGTTG<br>AAAAGAACGACACCAAGGCTATCTTTAAGTCTATTGACGA<br>CATGAAGTCATTGTTTGTTGACTCTGGTTCCTTGAAGTCCA<br>CTGCCACTTGGTTGGGTGCTGAAGCCATTGACCAATGTAG<br>ACAAGCCTGTGGTGGTCACGGTTACTCGTCCTACAACGGC<br>TTCGGTAAAGCCTACAACGATTGGGTTGTCCAATGTACTT<br>GGGAAGGTGACAACAATGTCTTGGCCATGAGTGTTGGTAA<br>GCCAATTGTCAAGCAAGTTATCAGCATTGAAGATGCCGGC<br>AAGACCGTCAGAGGTTCCACCGCTTTCTTGAACCAATTGA<br>AGGACTACACTGGTTCCAACAGCTCCAAGGTTGTTTTGAA<br>CACTGTTGCTGACTTGGACGACATCAAGACTGTCATCAAG<br>GCTATTGAAGTTGCCATCATCAGATTGTCCCAAGAAGCTG<br>CTTCTATTGTCAAGAAGGAATCTTTCGACTATGTCGGCGCT<br>GAATTGGTTCAACTCTCCAAGTTGAAGGCTCACCACTACT<br>TGTTGACTGAATACATCAGAAGAATTGACACCTTTGACCA<br>AAAGGACTTGGTTCCATACTTGATCACCCTCGGTAAGTTG<br>TACGCTGCCACTATTGTCTTGGACAGATTTGCCGGTGTCTT<br>CTTGACTTTCAACGTTGCCTCCACCGAAGCCATCACTGCTT<br>TGGCCTCTGTGCAAATTCCAAAGTTGTGTGCTGAAGTCAG<br>ACCAAACGTTGTTGCTTACACCGACTCCTTCCAACAATCC<br>GACATGATTGTCAATTCTGCTATTGGTAGATACGATGGTG<br>ACATCTATGAGAACTACTTTGACTTGGTCAAGTTGCAGAA<br>CCCACCATCCAAGACCAAGGCTCCTTACTCTGATGCTTTG<br>GAAGCCATGTTGAACAGACCAACCTTGGACGAAAGAGAA<br>AGATTTGAAAAGTCTGATGAAACCGCTGCTATCTTGTCCA<br>AGTAA |
| SEQ ID NO: 30 | acyl CoA oxidase, PDX4 (Candida strain ATCC20336) amino acid | MTFTKKNVSVSQGPDPRSSIQKERDSSKWNPQQMNYFLEGS<br>VERSELMKALAQQMERDPILFTDGSYYDLTKDQQRELTAVK<br>INRIARYREQESIDTFNKRLSLIGIFDPQVGTRIGVNLGLFLSCI<br>RGNGTTSQLNYWANEKETADVKGIYGCFGMTELAHGSNVA<br>GLETTATFDKESDEFVINTPHIGATKWWIGGAAHSATHCSVY<br>ARLIVDGQDYGVKTFVVPLRDSNHDLMPGVTVGDIGAKMG<br>RDGIDNGWIQFSNVRIPRFFMLQKFCKVSAEGEVTLPPLEQLS<br>YSALLGGRVMMVLDSYRMLARMSTIALRYAIGRRQFKGDN<br>VDPKDPNALETQLIDYPLHQKRLFPYLAAAYVISAGALKVED<br>TIHNTLAELDAAVEKNDTKAIFKSIDDMKSLFVDSGSLKSTA<br>TWLGAEAIDQCRQACGHGYSSYNGFGKAYNDWVVQCTW<br>EGDNNVLAMSVGKPIVKQVISIEDAGKTVRGSTAFLNQLKD<br>YTGSNSSKVVLNTVADLDDIKTVIKAIEVAIIRLSQEEAASIVK<br>KESFDYVGAELVQLSKLKAHHYLLTEYIRRIDTFDQKDLVPY<br>LITLGKLYAATIVLDRFAGVFLTFNVASTEAITALASVQIPKL<br>CAEVRPNVVAYTDSFQQSDMIVNSAIGRYDGDIYENYFDLV<br>KLQNPPSKTKAPYSDALEAMLNRPTLDERERFEKSDETAAIL<br>SK* |
| SEQ ID NO: 31 | acyl CoA oxidase, PDX5 (Candida strain ATCC20336) nucleotide | ATGCCTACCGAACTTCAAAAAGAAAGAGAACTCACCAAG<br>TTCAACCCAAAGGAGTTGAACTACTTCTTGGAAGGTTCCC<br>AAGAAAGATCCGAGATCATCAGCAACATGGTCGAACAAA<br>TGCAAAAAGACCCTATCTTGAAGGTCGACGCTTCATACTA<br>CAACTTGACCAAAGACCAACAAAGAGAAGTCACCGCCAA<br>GAAGATTGCCAGACTCTCCAGATACTTTGAGCACGAGTAC<br>CCAGACCAACAGGCCCAGAGATTGTCGATCCTCGGTGTCT<br>TTGACCCACAAGTCTTCACCAGAATCGGTGTCAACTTGGG<br>TTTGTTTGTTTCCTGTGTCCGTGGTAACGGTACCAACTCCC<br>AGTTCTTCTACTGGACCATAAATAAGGGTATCGACAAGTT<br>GAGAGGTATCTATGGTTGTTTTGGTATGACTGAGTTGGCC<br>CACGGTTCCAACGTCCAAGGTATTGAAACCACCGCCACTT<br>TTGACGAAGACACTGACGAGTTTGTCATCAACACCCCACA<br>CATTGGTGCCACCAAGTGGTGGATCGGTGGTGCTGCGCAC<br>TCCGCCACCCACTGCTCCGTCTACGCCAGATTGAAGGTCA<br>AAGGAAAGGACTACGGTGTCAAGACTTTTGTTGTCCCATT<br>GAGAGACTCCAACCACGACCTCGAGCCAGGTGTGACTGTT<br>GGTGACATTGGTGCCAAGATGGGTAGAGACGGTATCGAT<br>AACGGTTGGATCCAGTTCTCCAACGTCAGAATCCCAAGAT<br>CTTTTATGTTGCAAAAGTACTGTAAGGTTTCCCGTCTGGGT<br>GAAGTCACCATGCCACCATCTGAACAATTGTCTTACTCGG |

TABLE 40-continued

| SEQ ID NO: | Description | Sequence |
|---|---|---|
| | | CTTTGATTGGTGGTAGAGTCACCATGATGATGGACTCCTA<br>CAGAATGACCAGTAGATTCATCACCATTGCCTTGAGATAC<br>GCCATCCACAGAAGACAATTCAAGAAGAAGGACACCGAT<br>ACCATTGAAACCAAGTTGATTGACTACCCATTGCATCAAA<br>AGAGATTGTTCCCATTCTTGGCTGCCGCTTACTTGTTCTCC<br>CAAGGTGCCTTGTACTTAGAACAAACCATGAACGCAACCA<br>ACGACAAGTTGGACGAAGCTGTCAGTGCTGGTGAAAAGG<br>AAGCCATTGACGCTGCCATTGTCGAATCCAAGAAATTGTT<br>CGTCGCTTCCGGTTGTTTGAAGTCCACCTGTACCTGGTTGA<br>CTGCTGAAGCCATTGACGAAGCTCGTCAAGCTTGTGGTGG<br>TCACGGTTACTCGTCTTACAACGGTTTCGGTAAAGCCTACT<br>CCGACTGGGTTGTCCAATGTACCTGGGAAGGTGACAACAA<br>CATCTTGGCCATGAACGTTGCCAAGCCAATGGTTAGAGAC<br>TTGTTGAAGGAGCCAGAACAAAAGGGATTGGTTCTCTCCA<br>GCGTTGCCGACTTGGACGACCCAGCCAAGTTGGTTAAGGC<br>TTTCGACCACGCCCTTTCCGGCTTGGCCAGAGACATTGGT<br>GCTGTTGCTGAAGACAAGGGTTTCGACATTACCGGTCCAA<br>GTTTGGTTTTGGTTTCCAAGTTGAACGCTCACAGATTCTTG<br>ATTGACGGTTTCTTCAAGCGTATCACCCCAGAATGGTCTG<br>AAGTCTTGAGACCTTTGGGTTTCTTGTATGCCGACTGGATC<br>TTGACCAACTTTGGTGCCACCTTCTTGCAGTACGGTATCAT<br>TACCCCAGATGTCAGCAGAAAGATTCCTCCGAGCACTTC<br>CCAGCCTTGTGTGCCAAGGTTAGACCAAACGTTGTTGGTT<br>TGACTGATGGTTTCAACTTGACTGACATGATGACCAATGC<br>TGCTATTGGTAGATATGATGGTAACGTCTACGAACACTAC<br>TTCGAAACTGTCAAGGCTTTGAACCCACCAGAAAACACCA<br>AGGCTCCATACTCCAAGGCTTTGGAAGACATGTTGAACCG<br>TCCAGACCTTGAAGTCAGAGAAAGAGGTGAAAAGTCCGA<br>AGAAGCTGCTGAAATCTTGTCCAGTTAA |
| SEQ ID NO: 32 | acyl CoA oxidase, PDX5 (Candida strain ATCC20336) amino acid | MPTELQKERELTKFNPKELNYFLEGSQERSEIISNMVEQMQK<br>DPILKVDASYYNLTKDQQREVTAKKIARLSRYFEHEYPDQQ<br>AQRLSILGVFDPQVFTRIGVNLGLFVSCVRGNGTNSQFFYWT<br>INKGIDKLRGIYGCFGMTELAHGSNVQGIETTATFDEDTDEF<br>VINTPHIGATKWWIGGAAHSATHCSVYARLKVKGKDYGVK<br>TFVVPLRDSNHDLEPGVTVGDIGAKMGRDGIDNGWIQFSNV<br>RIPRFFMLQKYCKVSRSGEVTMPPSEQLSYSALIGGRVTMM<br>MDSYRMTSRFITIALRYAIHRRQFKKKDTDTIETKLIDYPLHQ<br>KRLFPFLAAAYLFSQGALYLEQTMNATNDKLDEAVSAGEKE<br>AIDAAIVESKKLFVASGCLKSTCTWLTAEAIDEARQACGGHG<br>YSSYNGFGKAYSDWVVQCTWEGDNNILAMNVAKPMVRDL<br>LKEPEQKGLVLSSVADLDDPAKLVKAFDHALSGLARDIGAV<br>AEDKGFDITGPSLVLVSKLNAHRFLIDGFFKRITPEWSEVLRP<br>LGFLYADWILTNFGATFLQYGIITPDVSRKISSEHFPALCAKV<br>RPNVVGLTDGFNLTDMMTNAAIGRYDGNVYEHYFETVKAL<br>NPPENTKAPYSKALEDMLNRPDLEVRERGEKSEEAAEILSS* |
| SEQ ID NO: 33 | Acyl-CoA Hydrolase (ACHA) Nucleotide Seq | atgatcagaaccgtcgttatcaatccctcaagaggttcagacctctggctttgtctcctgttttcgt<br>ccacgctacaactcccagaaggccaatttccaccgtccagaccaccctgggtccgacgagcca<br>gctgaagccgccgacgccgccgccacgatcctcgccgagttgcgagacaagcagacgaacc<br>cgaacaagtgccacctggctcgatgcgttaacggagcgggagaagttgcgtgccgagggcaag<br>acgattgacagtttcagctacgttgacccaagaccgtcgtggggagaagacacgcagt<br>gactcgttctcgttcttgttgttgccgttcaaggacgacaagtggttgtgtgacgcgtacatcaatg<br>cgtttggccggttgcgtgtagcgcagttgttccaggacttggacgccttggcggggcatcgc<br>gtacaggcactgttccccagcggagcccgtgaatgtcacggcgagcgtggataggaggtgtacat<br>ggtgaagaaagtggacgagattaacaattacaatttcgtgttggcggggtccgtgacgtggacc<br>gggagatcgtcgatggagatcacggtgaaagggtatgcttttgaagacgccgtgccgatataa<br>cgaacgaggagtccttgccggcagagaatgtgtttttggctgctaatttcaccttcgtggcacgga<br>acccacttacacacaagtcctttgctattaacagattgttgcccgtgactgagaaggactgggtcg<br>actatcgccgtgctgagtcccacaaacgccaaagaaagttgatggcaaagaacaagaagatctt<br>ggagcctaccgcggaagagtccaagttgatctacgacatgtgtgagatcgtccaagtccttacag<br>aacatcgagagggccaacgatgggatcgcgttcatgaaggacacgaccatgaagtccaccttg<br>ttcatgcagccccagtaccgtaacagacactcatacatgattttcggagggtacttgttaagacaa<br>actttcgaattggcctactgtaccgcggcaacgttttccctggccgggccccgtttcgtcagcttg<br>gactccaccacgttcaagaaccccgtgcccgtggggtcggtgctcaccatggactcgtcgatct<br>cgtacacggagcacgtgcacgagggagtggaggagattgacgcggactcaccgttcaacttca<br>gcttgcctgccacgaacaagatctcgaagaaccccgaggcgttcttgtcggaacccggcacgtt<br>gattcaagtcaaggtcgacacatacatccaggagttagagcaggagtgtgaagaagcccgcggg<br>tacgttcatctactcgttctatgttgataaagaaagcgttactgttgatggaaaggcgtcgttttgttc<br>agttatcccgcagacgtactccgagatgatgacttatgtgggcgggagaagaagagcccagga<br>tactgctaactacgtggagactttgccgtttagtggaagcggcaattaa |
| SEQ ID NO: 34 | Acyl-CoA Hydrolase (ACHA) Amino Acid Seq | MIRTVRYQSLKRFRPSALSPVFRPRYNSQKANFHRPDHPGSD<br>EPAEAADAAATILAELRDKQTNPNKATWLDALTEREKLRAE<br>GKTIDSFSYVDPKTTVVGEKTRSDSFSFLLLPFKDDKWLCDA<br>YINAFGRLRVAQLFQDLDALAGRIAYRHCSPAEPVNVTASV<br>DRVYMVKKVDEINNYNFVLAGSVTWTGRSSMEITVKGYAF |

TABLE 40-continued

| SEQ ID NO: | Description | Sequence |
| --- | --- | --- |
| | | EDAVPDITNEESLPAENVPLAANFTFVARNPLTHKSFAINRLL<br>PVTEKDWVDYRRAESHNAKKKLMAKNKKILEPTAEESKLIY<br>DMWRSSKSLQNIERANDGIAFMKDTTMKSTLFMQPQYRNR<br>HSYMIFGGYLLRQTFELAYCTAATFSSAGPRFVSLDSTTFKNP<br>VPVGSVLTMDSSISYTEHVHEGVEEIDADSPFNFSLPATNKIS<br>KNPEAFLSEPGTLIQVKVDTYIQELEQSVKKPAGTFIYSFYVD<br>KESVTVDGKASFCSVIPQTYSEMMTYVGGRRRAQDTANYVE<br>TLPFSGSGN |
| SEQ ID NO: 35 | Acyl-CoA Hydrolase (ACHB) Nucleotide Seq | atgatcagaaccgtccgttatcaatccttcaagaggttcaaacctctgactttatccccgttttccgt<br>ccacgctacaactcccagaaggccaatttccaccgtccagaccacgctgggtccgacgagcca<br>gccgaagccgccgacgccgctgccacgatcctcgccgagttgcgagacaagcagacgaacc<br>cgaacaaggccacctggctcgatgcgttaacggagcgggagaagttgcgtgccgagggcaag<br>acaatcgacagcttcagctacgttgaccccaagacaaccgtcgtggggagaagacacgcag<br>cgactcgttctcgttcttgttgttgccgttcaaggacgacaagtggttgtgtgacgcgtacatcaat<br>gcgtttggccggttgcgtgtagcgcagttgttccaggacttggacgccttggcgggccgcatcg<br>cgtacaggcactgttccccgctgagcccgtaatgtcacggcgagcgtggatagagtgtatat<br>ggtgaagaaagtggacgagattaataattacaatttcgtgttggcggggtccgtgacgtggaccg<br>ggagatcgtcgatggagatcacggtcaaagggtatgcttttgaagacgccgtgccggagataac<br>taacgaggagtccttgccggcagagaatgtgttcttggctgttaatttcaccttcgtggcacgtaac<br>ccactcacacacaagtccacgctattaacagattgagcccgtgactgagaaggactgggtcgat<br>tatccgccgtgctgagtcccacaacgccaagaagttgatggcaaagaacaagaagatcttgg<br>agcctacccccggaagagtccaagttgatctacgacatgtggagatcgtccaagtccttacagaac<br>atcgagaaggccaacgacgggatcgcgttcatgaaggacacgataatgaagtccaccttgttca<br>tgcagccccagtaccgtaacagacactcatacatgattttcggtgggtatagttaagacaaacttt<br>cgaattggcctattgtaccgcagcaacgttaccctggcgggacccgtttcgtcagcttggactc<br>caccacgttcaagaaccccgtgcccgtggggtcggtgctcaccatggactcgtcgatctcgtac<br>acggagcacgtccacgatggcgttgaggagattgacgccgactccccgttcaacttcagcttgc<br>ctgccacgaacaagatctcgaagaaccccgaggcgttcttgtcggagcccggcacgttgatcca<br>agtcaaggtcgacacgtacatccaggagttagagcaaagtgtgaagaagcctgcgggaacgtt<br>catctactcgttctctatgttgataaagagagcgttactgtggatggaaaaggcgtcgttttgttcagttat<br>cccgcagacgtactccgagatgatgacttatgtgggcgggagaagaagagcccaggatactgc<br>taattacgtggagactttgccgtttagtggaagcggcaattaa |
| SEQ ID NO: 36 | Acyl-CoA Hydrolase (ACHB) | MIRTVRYQSFKRFKPLTLSPVFRPRYNSQKANFHRPDHAGSD<br>EPAEAADAAATILAELRDKQTNPNKATWLDALTEREKLRAE<br>GKTIDSFSYVDPKTTVVGEKTRSDSFSFLLLPFKDDKWLCDA<br>YINAFGRLRVAQLFQDLDALAGRIAYRHCSPAEPVNVTASV<br>DRVYMVKKVDEINNYNFVLAGSVTWTGRSSMEITVKGYAF<br>EDAVPEITNEESLPAENVPLAVNFTFVARNPLTHKSFAINRLL<br>PVTEKDWVDYRRAESHNAKKKLMAKNKKILEPTPEESKLIY<br>DMWRSSKSLQNIEKANDGIAFMKDTIMKSTLFMQPQYRNRH<br>SYMIFGGYLLRQTFELAYCTAATFSLAGPRFVSLDSTTFKNP<br>VPVGSVLTMDSSISYTEHVHDGVEEIDADSPFNFSLPATNKIS<br>KNPEAFLSEPGTLIQVKVDTYIQELEQSVKKPAGTFIYSFYVD<br>KESVTVDGKASFCSVIPQTYSEMMTYVGGRRRAQDTANYVE<br>TLPFSGSGN |
| SEQ ID NO: 37 | E. coli Acyl-CoA Thioesterase (TESA) gene without signal peptide sequence optimized for C. tropicalis Nucleotide Seq | atggccgatacattgctcatcttgggtgactctttgtctgcagggtatcggatgtccgcatctgccg<br>catggcctgcactcctcaatgacaaatggcaaagcaagacatcggtcgtgaatgcatctatctct<br>ggcgataccctcgcagcagggggttggcccgtctcccagccttgttgaagcaacatcaaccacgtt<br>gggtcttggtcgaattgggcggcaatgatggtctcgagggttttcaacctcaacagaccgagcag<br>acattgcgtcaaatcctccaagacgtgaaggcagcaaacgccgaacctctcttgatgcagataa<br>gattgcctgccaactatggtcgtagatacaatgaagcctttctgcaatctacccgaagcttgcaaa<br>ggagtttgacgtcccattgttgccgttttttgatggaagaggtgtaccttaagcctcagtggatgcaa<br>gacgatggtatccatccgaaccgtgatgcacaaccattcatcgcagattggatggccaaacaact<br>ccaacctttggtcaatcatgatagctaa |
| SEQ ID NO: 38 | E. coli Acyl-CoA Thio esterase (TESA) without signal peptide Amino Acid Seq | MADTLLILGDSLSAGYRMSASAAWPALLNDKWQSKTSVVN<br>ASISGDTSQQGLARLRPLALLKQHQPRWVLVELGGNDGLRGFQ<br>PQQTEQTLRQILQDVKAANAEPLLMQIRLPANYGRRYNEAFS<br>AIYPKLAKEFDVPLLPFLMEEVYLKPQWMQDDGIHPNRDAQ<br>PFIADWMAKQLQPLVNHDS |
| SEQ ID NO: 39 | Acyl-CoA Synthetase (ACS1) Nuc. Seq | atgggtgccccttttaacagtcgccgttggcgaagcaaaaccaggcgaaaccgctccaagaaga<br>aaagccgctcaaaaaatggcctctgtcgaacgcccaacagactcaaaggcaaccacttttgcca<br>gacttcattgaagagtgttttgccagaaacggcaccagagatgccatggcctggagagacttggt<br>cgaaatccacgtcgaaaccaaacaggttacaaaatcattgacggcgaacagaaaaaggtcga<br>taggactggatctactacgaaatgggtccttacaactacatatcctacccccaagttgttgacgttg<br>gtcaagaactactccaagggtttgttggagttgggcttggcccccagatcaagaatccaagttgatg<br>atattgccagtacctcccacaagtggatgcagaccttcttagcctccagtttccaaggtatcccg<br>ttgtcaccgcctacgacaccttgggtgagtcggggcttgacccatcctcggtgcaaaccgaatcc<br>gatgccgtgttcaccgacaaccaattgttgtcctcctgattcgtcctggagaaggccaccctccg<br>tcaagtatgtcatccacggggaaagattgaccctaacgacaagagacagggcggcaaaatct<br>accaggatgcggaaaaggccaaggagaagatttacaaatttagaccagatattaaatttatttctttt<br>cgacgaggttgttgcattgggtgaacaatcgtccaaagaattgcatttcccaaaaccagaagacc<br>caatctgtatcatgtacacctcgggttccaccggtgctccaaagggtgtggttatcaccaatgcca |

TABLE 40-continued

| SEQ ID NO: | Description | Sequence |
|---|---|---|
| | | acattgttgccgccgtgggtggtatctccaccaatgctactagagacttggttagaactgtcgaca<br>gagtgattgcatttttgccattggcccacattttcgagttggcctttgagttggttaccttctggtggg<br>gggctccattgggttacgccaatgtcaagacttttgaccgaagcctcctgcagaaactgtcagcca<br>gacttgattgaattcaaaccaaccatcatggttggtgttgctgccgtttgggaatcggtcagaaag<br>ggtgtcttgtctaaattgaaacaggcttctccaatccaacaaaagatcttctgggctgcattcaatg<br>ccaagtctactttgaacctgtatggcttgccaggcggtgggttgtttgacgctgtcttcaagaaggt<br>taaagccgccactggtggccaattgcgttatgtggttgaatggtgggtccccaatctctgttgatgcc<br>caagtgtttatctccaccttgcttgcgccaatgttgttgggttacgggtttgactgaaacctgtgccaat<br>accaccattgtcgaacacacgcgcttccagattggtactttgggtaccttggttggatctgtcactg<br>ccaagttggttgatgttgctgatgctgatactacgccaagaacaaccagggtgaaatctggttga<br>aaggcggtccagttgtcaaggaatactacaagaacgaagaagaaaccaaggctgcattcaccg<br>aagatggcggttcaagactggtgatattggtgaatggaccgccgacggtggtttgaacatcattg<br>accgtaagaagaacttggtcaagactttgaatggtgaatacattgctttggagaaattggaaagtat<br>ttacagatccaaccacttgatttttgaacttgtgtgtttacgctgaccaaaccaaggttcaagccaattg<br>ctattgtcttgccaattgaagccaacttgaagtctatgtgaaggacgaaaagattatcccagatgc<br>tgattcacaagaattgagcagcttggttcacaacaagaaggttgcccaagctgtcttgagacactt<br>gctccaaaccggtaaacaacaaggtttgaaaggtattgaattgttgcagaatgttgtcttgttggat<br>gacgagtggaccccacagaatggttttgttacttctgcccaaaagttgcagagaaagaagattta<br>gaaagttgtaaaaaagaagttgaagaggcatacaagtcgtcttag |
| SEQ ID NO: 40 | Acyl-CoA Synthetase (ACS1) A.A. Seq | MGAPLTVAVGEAKPGETAPRRKAAQKMASVERPTDSKATT<br>LPDFIEECFARNGTRDAMAWRDLVEIHVETKQVTKIIDGEQK<br>KVDKDWIYYEMGPYNYISYPKLLTLVKNYSKGLLELGLAPD<br>QESKLMIFASTSHKWMQTFLASSFQGIPVVTAYDTLGESGLT<br>HSLVQTESDAVFTDNQLLSSLIRPLEKATSVKYVIHGEKIDPN<br>DKRQGGKIYQDAEKAKEKILQIRPDIKFISFDEVVALGEQSSK<br>ELHFPKPEDPICIMYTSGSTGAPKGVVITNANIVAAVGGISTN<br>ATRDLVRTVDRVIAFLPLAHIFELAFELVTFWWGAPLGYAN<br>VKTLTEASCRNCQPDLIEFKPTIMVGVAAVWESVRKGVLSK<br>LKQASPIQQKIFWAAFNAKSTLNRYGLPGGGLFDAVFKKVK<br>AATGGQLRYVLNGGSPISVDAQVFISTLLAPMLLGYGLTETC<br>ANTTIVEHTRFQIGTLGTLVGSVTAKLVDVADAGYYAKNNQ<br>GEIWLKGGPVVKEYYKNEEETKAAFTEDGWFKTGDIGEWT<br>ADGGLNIIDRKKNLVKTLNGEYIALEKLESIYRSNHLILNLCV<br>YADQTKVKPIAIVLPIEANLKSMLKDEKIIPDADSQELSSLVH<br>NKKVAQAVLRHLLQTGKQQGLKGIELLQNVVLLDDEWTPQ<br>NGFVTSAQKLQRKKILESCKKEVEEAYKSS |
| SEQ ID NO: 41 | Long-chain Acyl-CoA Synthetase (FAT1) Nuc. Seq | atgtcaggattagaaatagccgctgctgccatccttggtagtcagttattggaagccaaatatttaat<br>tgccgacgacgtgctgttagccaagacagtcgctgtcaatgccctcccatacttgtgaaagcca<br>gcagaggtaaggcatcatactggtacttttcgagcagtccgtgttcaagaacccaaacaacaaa<br>gcgttggcgttcccaagaccaagaaagaatgccccacccccaagaccgacgccgagggatt<br>ccagatctacgacgatcagtttgacctagaagaatacacctacaagaatttgtacgacatggtttt<br>gaagtactcatacatcttgaagaacgagtacgcgtcactgccaacgacaccatcggtgtttcttg<br>tatgaacaagccgcttttcattgtcttgtggttggcattgtggaacattggtgccttgctgcgttctt<br>gaacttcaacaccaaggacaagccattgatccactgtcttaagattgtcaacgcttcgcaagtttc<br>gttgacccggactgtgattcccccaatcagagatcgaggctcagatcagagaggaattgccac<br>atgtgcaaataaactacattgacgagtttgccttgtttgacagattgagactcaagtcgactccaaa<br>acacagagccgaggacaagaccagaagaccaaccgatactgactcctccgcttgtgcattgatt<br>tacacctcgggtaccaccggtttgccaaaagccggtatcatgtcctggagaaaagccttcatggc<br>ctcggttttcttttggccacatcatgaagattgactcgaaatcgaacgtcttgacccgccatgccttgt<br>accactccaccggccatgttggggttgtgtcctactttgattgtcggtggctgtgtctccgtgtc<br>ccagaaattctccgctacttcgttctgacccaggccagattatgtggtgccacccacgtgcaata<br>cgtcggtgaggtctgtcgttacttgttgaactccaagcctcatccagaccaagacagacaatgt<br>cagaattgcctacggtaacggggttgcgtccagatatatggtctgagttcaagcgcagattccacat<br>tgaaggtatcggtgagttctacgccgccaccgagttccctatcgccaccaccaacttgcagtacg<br>gtgagtacgtgtcggcgcctgtcgtaagtacgggtccctcatcagcttgttattgtcacccagc<br>agaaattggccaagatggacccagaagacgagtgaaatctacaaggaccccaagaccggg<br>ttctgtaccgaggccgcttacaacgagccaggtgagttgttgatgagaatcttgaaccctaacga<br>cgtgcagaaatccttccagggttattatgtgtaacaagtccgccaccaacgacaaaatcctcacca<br>atgttttcaaaaaaggtgacgcgtggtacagatccggtgacttgttgaagatggacgaggacaa<br>ttgttgtactttgtcgacagattaggtgacactttccgttggaagtccgaaaacgtctccgccaccg<br>aggtcgagaacgaattgatgggctccaaggccttgaagcagtccgtcgttgtcggtgtcaaggt<br>gccaaaccacgaaggtagagcctgttttgccgtctgtgaagccaaggacgagttgacgccatgaa<br>gaaatcttgaaattgattcactctcacgtgaccaagtctttgcctgtgtatgctcaacctgcgttcatc<br>aagattggcaccattgaggcttcgcacaaccacaaggttcctaagaaccaattcaagaaccaaa<br>agttgccaaagggtgaagacggcaaggatttgatctactggttgaatggcgacaagtaccagga<br>gttgactgaagacgattggtctttgatttgtaccggtaaagccaaattg |
| SEQ ID NO: 42 | Long-chain Acyl-CoA Synthetase (FAT1) A.A. Seq | MSGLEIAAAAILGSQLLEAKYLIADDVSLAKTVAVNALPYL<br>WKASRGKASYWYFFEQSVFKNPNNKALAFPRPRKNAPTPKT<br>DAEGFQIYDDQFDLEEYTYKELYDMVLKYSYILKNEYGVTA<br>NDTIGVSCMNKPLFIVLWLALWNIGALPAFLNFNTKDKPLIH<br>CLKIVNASQVFVDPDCDSPIRDTEAQIREELPHVQINYIDEFAL<br>FDRLRLKSTPKHRAEDKTRRPTDTSSACALIYTSGTTGLPK<br>AGIMSWRKAFMASVFFGHIMKIDSKSNVLTAMPLYHSTAAM<br>LGLCPTLIVGGCVSVSQKFSATSFWTQARLCGATHVQYVGE |

TABLE 40-continued

| SEQ ID NO: | Description | Sequence |
|---|---|---|
| | | VCRYLLNSKPHPDQDRHNVRIAYGNGLRPDIWSEFKRRFHIE GIGEFYAATESPIATTNLQYGEYGVGACRKYGSLISLLLSTQQ KLAKMDPEDESEIYKDPKTGFCTEAAYNEPGELLMRILNPND VQKSFQGYYGNKSATNSKILTNVFKKGDAWYRSGDLLKMD EDKLLYFVDRLGDTFRWKSENVSATEVENELMGSKALKQSV VVGVKVPNHEGRACFAVCEAKDELSHEEILKLIHSHVTKSLP VYAQPAFIKIGTIEASHNHKVPKNQFKNQKLPKGEDGKDLIY WLNGDKYQELTEDDWSLICTGKAKL |
| SEQ ID NO: 43 | Acyl-CoA Sterol acyl transferase (ARE1) Nuc. Seq | atgtccgacgacgagatagcaggaatagtcattgaaatcgacgatgacgtgaaatccacgtcttc gttccaggaagaactagtcgaggttgaaatgtccaactcgtccattaacgaatcccagaccgatg agtcgtaccgtcctgaagaaacctcattgcattacaggaggaagtcccacaggaccccgtcaga ggagtcgttcctagagatcaccaagaacgtgaatgatccggatctagtttccaagattgagaacct aaggggcaaagtaagccaacgggaagacaggttgaggaagcactaccttcacacctcccagg acgtcaagttcttgtcccggttcaacgacatcaagttcaagctgaactccgcgacgattctagattc ggatgcgttttacaagagtgaatactttggagtcttgaccatcttctgggtggttatcgcactctaca tattgtcaacgttgtcagatgtttactttggcatggccaagcccttactggactggatcatcatagga atgttcaagcaggacttggtgaaagttgcactcgttgatctgccatgtacctatcctcgtatttcctt atttcttgcaggttgcatgcaaacggggtgatgtatcttggcatggtcttggatgggcaatacagg gggatacagcaggtgatagacgactggacggtagaccgcaggagaggccatggatcacct tggattgcacgaattacttgatcagcattgcaggtgatattatgaagatgcagtcgtatgggcatt acaatggatacctagggatgtgtatcaggaaggattggcctctgaggctgatctcagggaccat ctgagtatgatgaagataccccctggatcacgtggaggactagaacagagcagtggatgcca aacacgagaggagatcaatcgaatggaactgctgagaggaaggaccaccatcaccatgtattc gacgaaaaggatgtcaacaaaccaatacgtgtcagcaagaagagggaattatcaagtaccgg caaacatcaacacaaggattatacgagtacagtatgacccaacgctagtctacacgagagatc ccccgaactcgacagattagatggacgtatgtgttgcagaaggattgggaacatagccaagtgt agccatgattatcgtcgccaagagagtactgccccagatgcaagaagagatcagtacacaa aattgccaaccaaccaaaggacccaaaatacacgtcgactacccacttgatattaccgctcggc aagcagtacagctctcattcatcctcatctggaatgaaaactcaacgcatagcggagaaagca ggtaggcgaccggcatactacggcgcaggtggtcgagcgtcgattacatgactattcaagaa atggaacaccatcgtgcaccgattcctccgtcggcacgatacaattcgagcattcacatcctcg gtataccaggacgcaagccgcgatagttacacattgattctgccacaatccacgaactcgttat gtacgtcctatttggcaaattacgagggtacctattcatacgatgcagtccagatccccatgacc gtcacctccaagttcaacaaccgtgtaggggcaacatcatgactggagacgtatttatctggccc cagcttggttagtgcgttgtatttactcttctag |
| SEQ ID NO: 44 | Acyl-CoA Sterol acyl transferase (ARE1) A.A. Seq | MSDDEIAGIVIEIDDDVKSTSSFQEELVEVEMSNSSINESQTDE SYRPEETSLHYRRKSHRTPSEESFLEITKNVDPDLVSKIENL RGKVSQREDRLRKHYLHTSQDVKFLSRFNDIKFKLNSATILD SDAFYKSEYFGVLTIFWVVIALYILSTLSDVYFGMAKPLLDW IIIGMFKQDLVKVALVDLAMYLSSYFPYFLQVACKRGDVSW HGLGWAIQGVYSLVFLTFWTVVPQELAMDLPWIARIFLILHC LVFIMKMQSYGHYNGYLWDVYQEGLASEADLRDLSEYDED FPLDHVEVLEQSLWFAKHELEFQSNGTAERKDHHHHVFDEK DVNKPIRVLQEEGIIKFPANINFKDYFEYSMFPTLVYTLSFPRT RQIRWTYVLQKVLGTFALVFAMIIVAEESFCPLMQEVDQYT KLPTNQRFPKYFVVLSHLILPLGKQYLLSFILIWNEILNGIAEL SRFGDRHFYGAWWSSVDYMDYSRKWNTIVHRFLRRHVYNS SIHILGISRTQAAIVTLLLSATIHELVMYVLFGKLRGYLFLTML VQIPMTVTSKFNNRVWGNIMFWLTYLSGPSLVSALYLLF |
| SEQ ID NO: 45 | Acyl-CoA Sterol acyl transferase (ARE2) Nuc. Seq | atgtccgacgacgagatagcaggaatagtcattgaaatcgacgatgacgtgaaatctacgtcttc gaccaggaagacctagtcgaggagagatgtccaactcgtccattaacgaatcccagacgatg agttgtcgtaccgtcctgaagaaatctcattgcattcgagaaggaagtcccacaagacccgtca gatgagtcgacctagagatcaccaagaacgtgaatgatccggatctagtctccaagattgagaa caaagggcaaagtaagccaacgggaagacaggagagggaaacactacctccacacatccca ggacgtcaagacagtctcggacaacgacatcaagacaagctgaactccgcgacgattctaga acggatgcgattacaagagcgagcactaggagtcagactatcactgggtggaatcggactct acataatgtcaacgttgtcagacatgtattaggcatggccaagcccttactggtggataatcat aggaatgacaagaaggatagatgcaagagcactcgagatcagtcatgtacttatcctcgtatat ccaatacctacaggagcatgcaagaccggagctatatcaggcatggtcaggatgggccatac agggggatacagcaggtgatttaactactgggcggtacaccgctggagctggccatggatca ccaggattgcacgagattcagatcagcattgcaggtgatattatgaagatgcagtcatatggac attacaatggatacctagggatgtatcaggaaggattggtctcggaagctgatctcacggctgt actgagtatgatgatgataccccctggatcacggggaggactagaacagagcagtggacgcc aaacacgagaggagatcaatctaatggaactacggagaggaaggatcaccatcatcatgtattc gacgaaaaggatgtcaacaaaccaatgcgtgtcagcaagaagagggatcttatcaaataccgg caaacatcaatacaaggattatacgagtacagtatgacccacgctagtctacacattgaacttc cccagaattcgacatattagatgggcgtatgtgagcagaaagattgggaacatagccaagtga tgccatgattatcgtcgccaagagagtactgtcccagatgcaagaagagaacagtacacaag attgccaaccaaccaaaggttctcaaagtacttcgtcgttcttcccacttgatattgccctcggca acagtacagctctcgatatcctcataggaacgaaaactcaacggcatagcggagtggagtcag gtaggggatcgccatactacggcgcctggtggtcaagcgtcgactacatggactattcaagaa atggaacacgatcgtgcaccgattcctccgccggcacgatacaattcgaccattcgcatcctcg gtataccaggacccaagccgcgataattacacattgattcagccacaatccacgaactcgttat gtacatcctataggaaaattacgagggtacctattcatacgatgcagtccagatccccatgaca |

TABLE 40-continued

| SEQ ID NO: | Description | Sequence |
|---|---|---|
| | | gtcaccgccaagttcaacaaccgtagtggggcaacatcatgactggagacgtatttatctggcc<br>ccagcttggttagtgcgttgtatttactcttctga |
| SEQ ID NO: 46 | Acyl-CoA Sterol acyl transferase (ARE2)<br>A.A. Seq | MSDDEIAGIVIEIDDDVKSTSSFQEDLVEVEMSNSSINESQTDE<br>LSYRPEEISLHSRRKSHKTPSDESFLEITKNVNDPDLVSKIENL<br>RGKVSQREDRLRKHYLHTSQDVKFLSRFNDIKFKSNSATILD<br>SDAFYKSEHFGVLTIFWVVIGLYIMSTLSDMYFGMAKPLSD<br>WIIIGMFKKDLMQVALVDLVMYLSSYFPYFLQVACKTGAIS<br>WHGLGWAIQGVYSLVFLTFWAVLPSESAMDLPWIARVFLIL<br>HCLVFIMKMQSYGHYNGYLWDVYQEGLVSEADLTAVSEYD<br>DDFPSDHGEVLEQSLWFAKHELEFQSNGTTERKDHHHHVFD<br>EKDVNKPMRVLQEEGIIKFPANINFKDYFEYSMFPTLVYTLN<br>FPRIRHIRWAYVLQKVLGTFALVFAMIIVAEESFCPLMQEVE<br>QYTRLPTNQRFSKYFVVLSHLILPLGKQYLLSFILIWNEILNGI<br>AELSRFGDRHFYGAWWSSVDYMDYSRKWNTIVHRFLRRHV<br>YNSTIRILGISRTQAAIITLLLSATIHELVMYILFGKLRGYLFLT<br>MLVQIPMTVTAKFNNRLWGNIMFWLTYLSGPSLVSALYLLF |
| SEQ ID NO: 47 | Diacylglycerol acyltransferase (DGA1)<br>Nuc. Seq | atgactcaggactataaagacgatagtcctacgtccactgagaggacactaacatagaagaggt<br>ggaaagcactgcaacccctagagtcggaactcagacagagaaaacagaccacggaaactccag<br>catcaaccccaccaccacctccacaacaacagcaggcgcataagaaagccctgaagaatggc<br>aagaggaagagaccatttataaacgtggcgccgctcaacaccccgttggctcacaggctcgag<br>actttggctgttgtttggcactgtgtcagtatcccgttctttatgttttttgttcttgcttacggtctccatg<br>gggttgcttgggtggttcttatcatttttgccatatttcatttggtggtacggtttcgacttgcacactcc<br>atcgaatggtaaagttgtctatcgtgtgcgcaactcgttcaagaatttcatcatttgggactggtttgt<br>caagtatttcccgattgaagtgcacaagacggtcgagttggatcctacttttagcgaattgcctgtg<br>gaagagagcggcgacagttcggacgacgacgaacaagacttggtgtctgagcagcagaac<br>taggagatcaaatcttcaagattcgggagaagaaacgcttgaatgacacctccctgggcaaac<br>cagagacattcaagaatgtgcctacgggtccaaggtatatttagggtaccacccacacgagtg<br>atactatgggggcagtggggagtagccaacaacgccttgaggaacgaaccatatacgccaatt<br>tccaaatggttaaaaccattcaccacgacagctccaaggggcgagagattgaccctggtattggc<br>aatatcacccattgacgcttaccacacagtagcgctcccatataccgtgactacttgatggctag<br>gggatcactagtgcatcggctaaaaacattagaagcttgatcaacaatggagacaactctgtgtgt<br>ctcgtcgttggcggtgcacaagaatcgttgttgaacaatatgattgccaagcacgccagagtcgg<br>gtacggttacaaagagagcctagatattcatggcgaccagtccgaagaagaagaagaagaaga<br>ggatgataccaagcagctagagaacccaagtcctaaacgtgaagtgcaattggtcttgaacaaa<br>cgtaaaggttttgtgaagttggctatcgaactaggaaatgtttccttggtgcctattttgcattcgga<br>gaagctgatgtttacagattgggcccagccagcaccaggctcgttcttgtacaagttccagcaatg<br>gatgaaggcaacttttcaattcaccatcccattgtttagtgctcgaggcgtgttcatctatgatttcg<br>attgttgccattcagaaacccaataaacatttgcgtcggtagaccccgtctacattccgcacaacgtc<br>ttgcaagaatacaagcaaaagcacccagaggagtttgccgaagaggaacctgccagtaccccg<br>atgaagaagtctggatctttcaccgatatgttcaaagctggtgaaaagaagcccaagacttcaagt<br>atcaagactaaaatcccacctgcattactagacaagtaccacaagctatacgtcgacgagttgaa<br>gaaggtctatgaagagaacaaggaaaggtttggctacggtgatgttgaattaaacattgtagaata<br>g |
| SEQ ID NO: 48 | Diacylglycerol acyltransferase (DGA1)<br>A.A. Seq | MTQDYKDDSPTSTELDTNIEEVESTATLESELRQRKQTTETP<br>ASTPPPPPQQQQAHKKASKNGKRKRPFINVAPLNTPLAHRLE<br>TLAVVWHCVSIPFFMFLFLLTVSMGLLGWFFIILPYFIWWYG<br>FDLHTPSNGKVVYRVRNSFKNFIIWDWFVKYFPIEVHKTVEL<br>DPTFSELPVEESGDSSDDDEQDLVSEHSRTLVDQIFKFFGLKK<br>RLNDTSSGKPETFKNVPTGPRYIFGYHPHGVISMGAVGLFAN<br>NALRNEPYTPISKWLKPFFHDSSKGERLFPGIGNIFPLTLTTQF<br>ALPFYRDYLMALGITSASAKNIRSLINNGDNSVCLVVGGAQE<br>SLLNNMIAKHARVGYGYKESLDIHGDQSEEEEEEDDTKQL<br>ENPSPKREVQLVLNKRKGFVKLAIELGNVSLVPIFAFGEADV<br>YRLAQPAPGSFLYKFQQWMKATFQFTIPLFSARGVFIYDFGL<br>LPFRNPINICVGRPVYIPHNVLQEYKQKHPEEFAEEEPASTPM<br>KKSGSFTDMFKAGEKKPKTSSIKTKIPPALLDKYHKLYVDEL<br>KKVYEENKERFGYGDVELNIVE |
| SEQ ID NO: 49 | Diacylglycerol acyltransferase (LRO1)<br>Nuc. Seq | atgtcgtcttttaaagaacagaaaatccgcaagcgtcgccacaagcgatacagaagactcagaaa<br>cagaggcagtatcctcctcaattgatcccaacggcaccatattgcgaccagtcctacatgacgaa<br>ccccaccacagccatcaccaccacaacataactagaccagtatttggaggacgatggcagcatc<br>ctggtgtccagaagatcgtcgatctccaaatccgacgacctgcaggcaaagcaaaagaagaag<br>aaacccaagaagaagatcttggagtctcgtcggtcatgtttatctttggtaccctcattgggttaat<br>ctttgcgtgggcgtttaccacagacacgcatcctttcaatggcgacttggagaagtttatcaactt<br>gaccagctcaacgggatcttgacgactggaagaactggaaggatatcttgcccaacagcatcc<br>agacgtacttgcaggaatcgggcaagggcgaagataacgacgggttgcatggtctggccgatt<br>cctctccgtcgggctccgcttgaaagcccagaagaacttcactgacaaccacaatgtcgtgttg<br>gttcctggtgtggtgagcacggggttggaatcgtggggaacaaccaccaccggtgattgtccat<br>ctatcggatacttcaggaagagattgtgggatcgttatatgttaagaacaatgattttggagaaa<br>acgtgctggttgaagcatatccagttggacgagaagacgtggttggatcctcccaatatttaaggt<br>ccgtcggcgcagggtttcgaagcggcagatttctttatggctgggtactggatctgaacaaga<br>tcttgcagaacttggcggttattgggtacgaccaaataacatggagtgctagttatgactgga<br>gattggcttacattgacttggagagaagagatggatattttcgaaacttaaagcgcagattgagtt<br>gaataacaagttgaacaacaagaagactgtgttgattggccactcgatggggacccagattattt |

TABLE 40-continued

| SEQ ID NO: | Description | Sequence |
|---|---|---|
| | | ctacttttttgaaatgggtcgaagccaccgggaaaccatactatggcaatggcggaccaaactgg<br>gtgaatgatcatattgagtcgattattgacatcagtgggtcgactttgggtaccccaagagtattc<br>ctgtgttgatctctggggaaatgaaagacaccgttcaattgaacgcgttggcggtttacgggttgg<br>agcaattttcagcaggcgtgaaagagtcgatatgttgcgtacatttggtggcgttgccagtatgtt<br>acccaaggggggagacaagatatggggcaacttgacgcatgcgccagatgatccaatttccac<br>attcagtgatgacgaagttacggacagccacgaacctaaagatcgttcttttggtacgtttatccaa<br>ttcaagaaccaaactagcgacgctaagccatacagggagatcaccatggctgaaggtatcgatg<br>aattgttggacaaatcaccagactggtattccaagagagtccgtgagaactactcttacggcatta<br>cagacagcaaggcgcaattagagaagaacaacaatgaccacctgaagtggtcgaacccattag<br>aagctgcctttgcctaaagcacccgacatgaagatctattgtttctacggagttggaaatcctaccg<br>aaagggcatacaagtatgtgactgccgataaaaaagccacgaaattggactacataatagacgc<br>cgacgatgccaatggagtcatattaggagacggagacggcactgtttcgttattaacccactcga<br>tgtgccatgagtgggccaagggagacaagtcgatacaacccagccaactcgaaggttacca<br>ttgttgaaatcaagcacgagccagacagatttgatttacgaggcggcgccaagactgcggaaca<br>tgttgatattttggggagtgccgagttgaacgagttgattttgactggttagcgggaacgggga<br>cgagattgagaatagatatgtcagcaacttaaaagaaatagtagaggccataaatttataa |
| SEQ ID NO: 50 | Diacylglycerol acyltransferase (LRO1) A.A. Seq | MSSLKNRKSASVATSDTEDSETEAVSSSIDPNGTILRPVLHDE<br>PHHSHHHHNITRPVLEDDGSISVSRRSSISKSDDSQAKQKKKK<br>PKKKILESRRVMFIFGTLIGLIFAWAFTTDTHPFNGDLEKFINF<br>DQLNGIFDDWKNWKDILPNSIQTYLQESGKGEDNDGLHGSA<br>DSFSVGLRLKAQKNFTDNHNVVLVPGVVSTGLESWGTTTTG<br>DCPSIGYFRKRLWGSFYMLRTMILEKTCWLKHIQLDEKTGL<br>DPPNIKVRAAQGFEAADFFMAGYWIWNKILQNLAVIGYGPN<br>NMVSASYDWRLAYIDLERRDGYFSKLKAQIELNNKLNNKKT<br>VLIGHSMGTQIIFYFLKWVEATGKPYYGNGGPNWVNDHIESI<br>IDISGSTLGTPKSIPVLISGEMKDTVQLNALAVYGLEQFFSRRE<br>RVDMLRTFGGVASMLPKGGDKIWGNLTHAPDDPISTFSDDE<br>VTDSHEPKDRSFGTFIQFKNQTSDAKPYREITMAEGIDELLDK<br>SPDWYSKRVRENYSYGITDSKAQLEKNNNDHSKWSNPLEAA<br>LPKAPDMKIYCFYGVGNPTERAYKYVTADKKATKLDYIIDA<br>DDANGVILGDGDGTVSLLTHSMCHEWAKGDKSRYNPANSK<br>VTIVEIKHEPDRFDLRGGAKTAEHVDILGSAELNELILTVVSG<br>NGDEIENRYVSNLKEIVEAINL |
| SEQ ID NO: 51 | Thioesterase activity, *Cuphea lanceolata* (Nucleic Acid Seq) | atggtggctgctgcagcaacttctgcattcttcccgttccagccccgggaacctcccctaaacccggg<br>aagtccggcaactggccatcgagcttgagccctaccttcaagcccaagtcaatccccaatgctggattt<br>caggttaaggcaaatgccagtgccatcctaaggctaacggttctgcagtaaatctaaagtctggcagc<br>ctcaacactcaggaggacaacttcgtcgtccctcctccccgggcttcctcaacagttgcctgattga<br>gtatgcttctgactgcaatcacgactcttcgtggcggcagaagcagtggactatgcttgataga<br>aatctaaggcctgacatgctcgtggactcggttgggttgaagagtattgttcgggatgggtcgtgt<br>ccagacagagttattgattagatcttatgaaataggcgctgatcgaacagcctctatagagacgctgat<br>gaaccacttgcaggaaactctatcaattgtaagagtttgggtcttctcaatgacggcgttggtcgta<br>ctcctgggatgtgtaaaaacgacctcatttgggtgcttacaaaaatgcagatcatggtgaatcgctaccc<br>aacttggggcgatactgttgagatcaatacctggttctctcagtcggggaaaatcggtatggctagcgat<br>tggctaataagtgattgcaacacaggagaaattcttataagagcaacgagcgtgtgggctatgatgaat<br>caaaagacgagaagattctcaagacttccatacgaggttcgcagggagttaacacctcattttgtggact<br>ctcctcatgtcattgaagacaatgatcagaaattgcataagtttgatgtgaagactggtgattccattcgc<br>aagggtctaactccgaggtggaatgacttggatgtgaatcagcacgtaagcaacgtgaagtacattgg<br>gtggattctcgagagtatgccaatagaagttttggagacccaggagctatgctctctcaccgttgaatat<br>aggcgggaatgcggaatggacagtgtgccggagtccgtgactgctgtggatccctcagaaatggag<br>gccggtctcagtacaagcaccttttgcggcttgaggatgggactgatatcgtgaagagcagaactgag<br>tggcgaccgaagaatgcaggaactaacggggcgatatcaacatcaacagcaaagacttcaaatgga<br>aactcggcctcttag |
| SEQ ID NO: 52 | CYP52A12, ATCC20336 (Amino Acid Seq.) | MATQEIIDSVLPYLTKWYTVITAAVLVFLISTNIKNYVKAKKLKC<br>VDDPPYLKDAGLTGISSLIAAIKAKNDGRLANFADEVFDEYPNHTF<br>YLSVAGALKIVMTVDPENIKAVLATQFTDFSLGTRHAHFAPLLG<br>DGIFTLDGEGWKHSRAMLRPQFARDQIGHVKALEPHIQIMAKQI<br>KLNNQGKTFDIQELFFRFTVDTATEFLFGESVHSLYDEKLGIPTPNE<br>IPGRENFAAAFNVSQHYLATRSYSQTFYPLTNPKEFRDCNAKVH<br>HLAKYFVNKALNFTPEELEEKSKSGYVFLYELVKQTRDPKVLQ<br>DQLLNIMVAGRDTTAGLLSFALFELARHPEMWSKLREEIEVNFG<br>VGEDSRVEEITFEALKRCEYLKAILNETLRMYPSVPVNFRTATRD<br>TTLPRGGGANGTDPIYIPKGSTVAYVVYKTHRLEEYYGKDANDF<br>RPERWFEPSTKKLGWAYVPFNGGPRVCLGQQFALTEASYVITRL<br>AQMFETVSSDPGLEYPPPKCIHLTMSHNDGVFVKM* |
| SEQ ID NO: 53 | CYP52A13, ATCC20336 (Amino Acid Seq.) | MTVHDIIATYFTKWYVIVPLALIAYRVLDYFYGRYLMYKLGAK<br>PFFQKQTDGCFGFKAPLELLKKKSDGTLIDFTLQRIHDLDRPDIPT<br>FTFPVFSINLVNTLEPENIKAILATQFNDFSLGTRHSHFAPLLGDGI<br>FTLDGAGWKHSRSMLRPQFAREQISHVKLLEPHVQVFFHNL<br>AQGKTFDIQELFFRLTVDSATEFLFGESVESLRDESIGMSINALDF<br>DGKAGFADAFNYSQNYLASRAVMQQLYWVLNGKKFKECNAK<br>VHKFADYYVNKALDLTPEQLEKQDGYVFLYELVKQTRDKQVL<br>RDQLLNIMVAGRDTTAGLLSFVFFELARNPEVTNKLREEIEDKF<br>GLGENASVEDISFESLKSCEYLKAVLNETLRLYPSVPQNFRVATK |

TABLE 40-continued

| SEQ ID NO: | Description | Sequence |
|---|---|---|
| | | NTTLPRGGGKDGLSPVLVRKGQTVIYGVYAAHRNPAVYGKDAL<br>EFRPERWFEPETKKLGWAFLPFNGGPRICLGQQFALTEASYVTV<br>RLLQEFAHLSMDPDTEYPPKKMSHLTMSLFDGANIEMY* |
| SEQ ID NO: 54 | CYP52A14,<br>ATCC20336<br>(Amino Acid<br>Seq.) | MTAQDIIATYITKWYVIVPLALIAYRVLDYFGRYLMYKLGAKP<br>FFQKQTDGYFGFKAPLELLKKKSDGTLIDFTLERIQALNRPDIPTF<br>TFPIFSINLISTLEPENIKAILATQFNDFSLGTRHSHFAPLLGDGIFT<br>LDGAGWKHSRSMLRPQFAREQISHVKLLEPHMQVFFKHVRKAQ<br>GKTFDIQELFFRLTVDSATEFLFGESVESLRDESIGMSINALDFDG<br>KAGFADAFNYSQNYLASRAVMQQLYWVLNGKKFKECNAKVH<br>KFADYVVSKALDLTPEQLEKQDGYVFLYELVKQTRDRQVLRDQ<br>LLNIMVAGRDTTAGLLSFVFFELARNPEVTNKLREEIEDKFGLGE<br>NARVEDISFESLKSCEYLKAVLNETLRLYPSVPQNFRVATKNTTL<br>PRGGGKDGLSPVLVRKGQTVMYGVYAAHRNPAVYGKDALEFR<br>PERWFEPETKKLGWAFLPFNGGPRICLGQQFALTEASYVTVRLL<br>QEFGHLSMDPNTEYPPRKMSHLTMSLFDGANIEMY* |
| SEQ ID NO: 55 | CYP52A15,<br>ATCC20336<br>(Amino Acid<br>Seq.) | MSSSPSFAQEVLATTSPYIEYFLDNYTRWYYFIPLVLLSLNFISLL<br>HTRYLERRFHAKPLGNFVRDPTFGIATPLLLIYLKSKGTVMKFA<br>WGLWNNKYIVRDPKYKTTGLRIVGLPLIETMDPENIKAVLATQF<br>NDFSLGTRHDFLYSLLGDGIFTLDGAGWKHSRTMLRPQFAREQ<br>VSHVKLLEPHVQVFFKHVRKHRGQTFDIQELFFRLTVDSATEFLF<br>GESAESLRDESIGLTPTTKDFDGRRDFADAFNYSQTYQAYRFLL<br>QQMYWILNGSEFRKSIAVVHKFADHYVQKALELTDDDLQKQD<br>GYVFLYELAKQTRDPKVLRDQLLNILVAGRDTTAGLLSFVFYEL<br>SRNPEVFAKLREEVENRFGLGEEARVEEISFESLKSCEYLKAVIN<br>ETLRLYPSVPHNFRVATRNTTLPRGGGEDGYSPIVVKKGQVVM<br>YTVIATHRDPSIYGADADVFRPERWFEPETRKLGWAYVPFNGGP<br>RICLGQQFALTEASYVTVRLLQEFAHLSMDPDTEYPPKLQNTLT<br>LSLFDGADVRMY* |
| SEQ ID NO: 56 | CYP52A16,<br>ATCC20336<br>(Amino Acid<br>Seq.) | MSSSPSFAQEVLATTSPYIEYFLDNYTRWYYFIPLVLLSLNFISLL<br>HTKYLERRFHAKPLGNVVLDPTFGIATPLILIYLKSKGTVMKFA<br>WSFWNNKYIVKDPKYKTTGLRIVGLPLIETIDPENIKAVLATQFN<br>DFSLGTRHDFLYSLLGDGIFTLDGAGWKHSRTMLRPQFAREQVS<br>HVKLLEPHVQVFFKHVRKHRGQTFDIQELFFRLTVDSATEFLFG<br>ESAESLRDDSVGLTPTTKDFEGRGDFADAFNYSQTYQAYRFLLQ<br>QMYWILNGAEFRKSIAVVHKFADHYVQKALELTDDDLQKQDGY<br>VFLYELAKQTRDPKVLRDQLLNILVAGRDTTAGLLSFVFYELSR<br>NPEVFAKLREEVENRFGLGEEARVEEISFESLKSCEYLKAVINEA<br>LRLYPSVPHNFRVATRNTTLPRGGGKDGCSPIVVKKGQVVMYT<br>VIGTHRDPSIYGADADVFRPERWFEPETRKLGWAYVPFNGGPRI<br>CLGQQFALTEASYVTVRLLQEFGNLSSDPNAEYPPKLQNTLTLS<br>LFDGADVRMF* |
| SEQ ID NO: 57 | CYP52A17,<br>ATCC20336<br>(Amino Acid<br>Seq.) | MIEQLLEYWYVVVPVLYIIKQLLAYTKTRVLMKKLGAAPVTNK<br>LYDNAFGIVNGWKALQFKKEGRAQEYNDYKFDHSKNPSVGTY<br>VSILFGTRIVVTKDPENIKAILATQFGDFSLGKRHTLFKPLLGDGI<br>FTLDGEGWKHSRAMLRPQFAREQVAHVTSLEPHFQLLKKHILK<br>HKGEYFDIQELFFRFTVDSATEFLFGESVHSLKDESIGINQDDIDF<br>AGRKDFAESFNKAQEYLAIRTLVQFTFYWLVNNKEFRDCTKSVH<br>KFTNYYVQKALDASPEELEKQSGYVFLYELVKQTRDPNVLRDQ<br>SLNILLAGRDTTAGLLSFAVFELARHPEIWAKLREEIEQQFGLGE<br>DSRVEEITFESLKRCEYLKAFLNETLRIYPSVPRNFRIATKNTTLP<br>RGGGSDGTSPILIQKGEAVSYGINSTHLDPVYYGPDAAEFRPER<br>WFEPSTKKLGWAYLPFNGGPRICLGQQFALTEAGYVLVRLVQE<br>FSHVRSDPDEVYPPKRLTNLTMCLQDGAIVKFD* |
| SEQ ID NO: 58 | CYP52A18,<br>ATCC20336<br>(Amino Acid<br>Seq.) | MIEQILEYWYIVVPVLYIIKQLIAYSKTRVLMKQLGAAPITNQLY<br>DNVFGIVNGWKALQFKKEGRAQEYNDHKFDSSKNPSVGTYVSI<br>LFGTKIVVTKDPENIKAILATQFGDFSLGKRHALFKPLLGDGIFTL<br>DGEGWKHSRSMLRPQFAREQVAHVTSLEPHFQLLKKHILKHKG<br>EYFDIQELFFRFTVDSATEFLFGESVHSLKDETIGINQDDIDFAGR<br>KDFAESFNKAQEYLSIRILVQFTFYWLINNKEFRDCTKSVHKFTNY<br>YVQKALDATPEELEKQGGYVFLYELVKQTRDPKVLRDQSLNILL<br>AGRDTTAGLLSFAVFELARNPHIWAKLREEIEQQFGLGEDSRVE<br>EITFESLKRCEYLKAFLNETLRVYPSVPRNFRIATKNTTLPRGGGP<br>DGTQPILIQKGEGVSYGINSTHLDPVYYGPDAAEFRPERWFEPST<br>RKLGWAYLPFNGGPRICLGQQFALTEAGYVLVRLVQEFSHIRSD<br>PDEVYPPKRLTNLTMCLQDGAIVKFD* |
| SEQ ID NO: 59 | CYP52A19,<br>ATCC20336<br>(Amino Acid<br>Seq.) | MLDQILHYWYIVLPLLAIINQIVAHVRTNYLMKKLGAKPFTHVQ<br>RDGWLGFKFGREFLKAKSAGRSVDLIISRFHDNEDTFSSYAFGN<br>HVVFTRDPENIKALLATQFGDFSLGSRVKFFKPLLGYGIFTLDAE<br>GWKHSRAMLRPQFAREQVAHVTSLEPHFQLLKKHILKHKGEYF<br>DIQELFFRFTVDSATEFLFGESVHSLKDEEIGYDTKDMSEERRRF<br>ADAFNKSQVYVATRVALQNLYWLVNNKEFKECNDIVHKFTNY |

TABLE 40-continued

| SEQ ID NO: | Description | Sequence |
|---|---|---|
| | | YVQKALDATPEELEKQGGYVFLYELVKQTRDPKVLRDQSLNILL
AGRDTTAGLLSFAVFELARNPHIWAKLREEIEQQFGLGEDSRVE
EITFESLKRCEYLKAVLNETLRLHPSVPRNARFAIKDTTLPRGGG
PNGKDPILIRKDEVVQYSISATQTNPAYYGADAADFRPERWFEPS
TRNLGWAFLPFNGGPRICLGQQFALTEAGYVLVRLVQEFPNLSQ
DPETKYPPPRLAHLTMCLFDGAHVKMS* |
| SEQ ID NO: 60 | CYP52A20, ATCC20336 (Amino Acid Seq.) | MLDQIFHYWYIVLPLLVIIKQIVAHARTNYLMKKLGAKPFTHVQ
LDGWFGFKFGREFLKAKSAGRQVDLIISRFHDNEDTFSSYAFGN
HVVFTRDPENIKALLATQFGDFSLGSRVKFFKPLLGYGIFTLDGE
GWKHSRAMLRPQFAREQVAHVTSLEPHFQLLKKHILKHKGEYF
DIQELFFRRFTVDSATEFLFGESVHSLRDEEIGYDTKDMAEERRKF
ADAFNKSQVYLSTRVALQTLYWLVNNKEFKECNDIVHKFTNYY
VQKALDATPEELEKQGGYVFLYELAKQTKDPNVLRDQSLNILL
AGRDTTAGLLSFAVFELARNPHIWAKLREEIESHFGSGEDSRVEE
ITFESLKRCEYLKAVLNETLRLHPSVPRNARFAIKDTTLPRGGGP
NGKDPILIRKNEVVQYSISATQTNPAYYGADAADFRPERWFEPS
TRNLGWAYLPFNGGPRICLGQQFALTEAGYVLVRLVQEFPSLSQ
DPETEYPPPRLAHLTMCLFDGAYVKMQ* |
| SEQ ID NO: 61 | CYP52D2, ATCC20336 (Amino Acid Seq.) | MAISSLLSWDVICVVFICVCVYFGYEYCYTKYLMHKHGAREIEN
VINDGFFGPRLPLLLMRASNEGRLIEFSVKRFESAPHPQNKTLVN
RALSVPVILTKDPVNIKAMLSTQFDDFSLGRLRHQFAPLLGKGIF
TLDGPEWKQSRSMLRPQFAKDRVSHISDLEPHFVLLRKHIDGHN
GDYFDIQELYFRFSMDVATGFLFGESVGSLKDEDARFSEAFNES
QKYLATRATLHELYFLCDGFRFRQYNKVVRKFCSQCVHKALDV
APEDTSEYVFLRELVKHTRDPVVLQDQALNVLLAGRDTTASLLS
FATFELARNDHMWRKLREEVISTMGPSSDEITVAGLKSCRYLKA
ILNETLRLYPSVPRNARFATRNTTLPRGGGPDGSFPILIRKGQPVG
YFICATHLNEKVYGNDSHVFRPERWAALEGKSLGWSYLPFNGG
PRSCLGQQFAILEASYVLARLTQCYTTIQLRTTEYPPKKLVHLTM
SLLNGVYIRTRT* |
| SEQ ID NO: 62 | ADH1-1, Candida (Amino Acid Seq.) | MHALFSKSVFLKYVSSPTTSAIPHSSEFIVPRSFYLRRSISPYLPHS
SLFPSFSYSSSSVYTKKSFHTMSANIPKTQKAVVFEKNGGELEYK
DIPVPTPKANELLINVKYSGVCHTDLHAWKGDWPLATKLPLVG
GHEGAGVVVGMGENVKGWKIGDFAGIKWLNGSCMSCEFCQQG
AEPNCGEADLSGYTHDGSFEQYATADAVQAARIPAGTDLAEVA
PILCAGVTVYKALKTADLAAGQWVAISGAGGGLGSLAVQYAV
AMGLRVVAIDGGDEKGAFVKSLGAEAYIDFLKEKDIVSAVKKA
TDGGPHGAINVSVSEKAIDSVEYVRPLGKVVLVGLPAGSKVTA
GVFEAVVKSIEIKGSYVGNRKDTAEAVDFFSRGLIKCPIKIVGLSE
LPQVFKLMEEGKILGRYVLDTSK |
| SEQ ID NO: 63 | NADPH cytochrome P450 reductase, CPR (Candida strain ATCC750)(Amino Acid Seq.) | MALDKLDLYVIITLVVAIAAYFAKNQFLDQQQDTGFLNTDSGD
GNSRDILQALKKNNKNTLLLFGSQTGTAEDYANKLSRELHSRFG
LKTMVADFADYDFENFGDITEDILVFFIVATYGEGEPTDNADEF
HTWLTEEADTLSTLKYTVFGLGNSTYEFFNAIGRKFDRLLGEKG
GDRFAEYGEGDDGTGTLDEDFLAWKDNVFDSLKNDLNFEEKEL
KYEPNVKLTERDDLSGNDPDVSLGEPNKYIKSEGVDLTKGPFD
HTHPFLARIVKTKELFTSEDRHCVHVEFDISESNLKYTTGDHLAI
WPSNSDENIKQFAKCFGLEDKLDTVIELKALDSTYSIPFPNPITYG
AVIRHHLEISGPVSRQFFLSIAGFAPDEETKKSFTRIGGDKQEFAS
KVTRRKFNIADALLFASNNRPWSDVPFEFLIENVQHLTPRYYSIS
SSSLSEKQTINVTAVVEAEEEADGRPVTGVVTNLLKNIEIEQNKT
GETPMVHYDLNGPRGKFSKFRLPVHVRRSNFKLPKNSTTPVILIG
PGTGVAPLRGFVRERVQQVKNGVNVGKTVLFYGCRNSEQDFLY
KQEWSEYASVLGENFEMFNAFSRQDPTKKVYVQDKILENSALV
DELLSSGAIIYVCGDASRMARDVQAAIAKIVAKSRDIHEDKAAE
LVKSWKVQNRYQEDVW |
| SEQ ID NO: 64 | NADPH cytochrome P450 reductase A, CPRA (Candida strain ATCC20336) (Amino Acid Seq.) | MALDKLDLYVIITLVVAVAAYFAKNQFLDQPQDTGFLNTDSGS
NSRDVLSTLKKNNKNTLLLFGSQTGTAEDYANKLSRELHSRFGL
KTMVADFADYDWDNFGDITEDILVFFIVATYGEGEPTDNADEF
TWLTEEADTLSTLKYTVFGLGNSTYEFFNAIGRKFDRLLSEKGG
DRFAEYAEGDDGTGTLDEDFMAWKDNVFDALKNDLNFEEKEL
KYEPNVKLTERDDLSAADSQVSLGEPNKKYINSEGIDLTKGPFD
HTHPFLARITETRELFSSKDRHCIHVEFDISESNLKYTTGDHLAIW
PSNSDENIKQFAKCFGLEDKLDTVIELKALDSTYTIPFPTPITYGA
VIRHHLEISGPVSRQFFLSIAGFAPDEETKKAFTRLGGDKQEFAA
KVTRRKFNIADALLYSSNNAPWSDVPFEFLIENVPHLTPRYYSISS
SSLSEKQLINVTAVVEAEEEADGRPVTGVVTNLLKNVEIVQNKT
GEKPLVHYDLSGPRGKFNKFKLPVHVRRSNFKLPKNSTTPVILIG
PGTGVAPLRGFVRERVQQVKNGVNVGKTLLFYGCRNSNEDFLY
KQEWAEYASVLGENFEMFNAFSRQDPSKKVYVQDKILENSQLV
HELLTEGAIIYVCGDASRMARDVQTTISKIVAKSREISEDKAAEL
VKSWKVQNRYQEDVW |

TABLE 40-continued

| SEQ ID NO: | Description | Sequence |
|---|---|---|
| SEQ ID NO: 65 | NADPH cytochrome P450 reductase B, CPRB (Candida strain ATCC20336) (Amino Acid Seq.) | MALDKLDLYVIITLVVAVAAYFAKNQFLDQPQDTGFLNTDSGS NSRDVLSTLKKNNKNTLLLFGSQTGTAEDYANKLSRELHSRFGL KTMVADFADYDWDNFGDITEDILVFFIVATYGEGEPTDNADEFH TWLTEEADTLSTLRYTVFGLGNSTYEFFNAIGRKFDRLLSEKGG DRFAEYAEGDDGTGTLDEDFMAWKDNVFDALKNDLNFEEKEL KYEPNVKLTERDDLSAADSQVSLGEPNKKYINSEGIDLTKGPFD HTHPYLARITETRELFSSKERHCIHVEFDISESNLKYTTGDHLAIW PSNSDENIKQFAKCFGLEDKLDTVIELKALDSTYTIPFPTPITYGA VIRHHLEISGPVSRQFFLSIAGFAPDEETKKTFTRLGGDKQEFATK VTRRKFNIADALLYSSNNTPWSDVPFEFLIENIQHLTPRYYSISSS SLSEKQLINVTAVVEAEEEADGRPVTGVVTNLLKNIEIAQNKTG EKPLVHYDLSGPRGKFNKFKLPVHVRRSNFKLPKNSTTPVILIGP GTGVAPLRGFVRERVQQVKNGVNVGKTLLFYGCRNSNEDFLYK QEWAEYASVLGENFEMFNAFSRQDPSKKVYVQDKILENSQLVH ELLTEGAIIYVCGDASRMARDVQTTISKIVAKSREISEDKAAELV KSWKVQNRYQEDVW |
| SEQ ID NO: 66 | NADPH P450 cytochrome reductase (Bacillus megaterium) (Nucleid Acid Seq.) | atgacaattaaagaaatgcctcagccaaaaacgtttggagagcttaaaaatttaccgttattaaacacag ataaaccggttcaagcttttgatgaaaattgcggatgaattaggagaaatctttaaattcgaggcgcctgg tcgtgtaacgcgctacttatcaagtcagcgtctaattaaagaagcatgcgatgaatcacgctttgataaa aacttaagtcaagcgcttaaatttgtacgtcagtttttgcaggagacgggttatttacaagctggacgcatga aaaaaattggaaaaaagcgcataatatcttacttccaagcttcagtcagcaggcaatgaaaggctatcat gcgatgatggtcgatatcgccgtgcagcttgttcaaaagtgggagcgtctaaatgcagatgagcatatt gaagtaccggaagacatgacacgtttaacgcttgatacaattggtattgcggctttaactatcgctttaa cagctttttaccgagatcagcctcatccatttattacaagtatggtccgtgcactggatgaagcaatgaac aagctgcagcgagcaaatccagacgacccagcttatgatgaaaacaagcgccagtttcaagaagata tcaaggtgatgaacgacctagtagataaaattattgcagatcgcaaagcaagcggtgaacaaagcgat gatttattaacgcatatgctaaacgaaaagatccagaaacgggtgagccgcttgatgacgagaacatt cgctatcaaattattacattcttaattgcgggacacgaaacaacaagtggtcttttatcatttgcgctgtattt cttagtgaaaaaatccacatgtattacaaaaagcagcaagaagcagcacgagttctagtagatcctgt tccaagctacaaacaagtcaaacagcttaaatatgtcggcatggtcttaaacgaagcgctgcgcttatg gccaactgctcctgcgttttccctatatgcaaaagaagatacggtgcttggaggagaatatccttagaa aaaggcgacgaactaatggtctgattcctcagcttcaccgtgataaaacaatttggggagacgatgtg gaagagttccgtccagagcgttttgaaaatccaagtgcgattccgcagcatgcgtttaaaccgtttggaa acggtcagcgtgcgtgtatcggtcagcagttcgctcttcatgaagcaacgctggtacttggtatgatgct aaaaacactttgactttgaagatcatacaaactacgagctggatattaaagaaacttttaacgttaaaccctg aaggctttgtggtaaaagcaaatcgaaaaaaattccgcttggcggtattccttcacctagcactgaaca gtctgctaaaaaagtacgcaaaaagcagaaaacgctcataatacgcccgctgcttgctatacggttc aaatatgggaacagctgaaggaacggcgcgtgatttagcagatattgcaatgagcaaaggatttgcac cgcaggtcgcaacgcttgattcacacgccggaaatcttccgcgcgaaggagctgtattaattgtaacg gcgtcttataacggtcatccgcctgataacgcaaagcaatttgtcgactggttagaccaagcgtctgctg atgaagtaaaaggcgttcgctactccgtatttggatgcggcgataaaaactgggctactacgtatcaaa aagtgcctgcttttatcgatgaaaacgcttgccgctaaaggggcgaaaacatcgctgaccgcggtgaa gcagatgcaagcgacgactttgaaggcacatatgaagaatggcgtgaacatatgtggagtgacgtag cagcctacttaacctcgacattgaaaacagtgaagataataaatctactctttcacttcaatttgtcgaca gcgccgcggatatgccgcttgcgaaaatgcacggtgcgttttcaacgaacgtcgtagcaagcaaaga acttcaacagccaggcagtgcacgaagcacgcgacatcttgaaattgaacttccaaaagaagcttcta tcaagaaggagatcatttaggtgttattcctcgcaactatgaaggaatagtaaaccgtgtaacagcaag gttcggcctagatgcatcacagcaaatccgtctggaagcagaagaagaaaaaattagctcatttgccact cgctaaaacagtatccgtagaagagcttctgcaatacgtggagcttcaagatcctgttacgcgcacgca gcttcgcgcaatggctgctaaaacggtctgcccgccgcataaagtagagcttgaagccttgcttgaaa agcaagcctacaaagaacaagtgctggcaaaacgtttaacaatgcttgaactgcttgaaaaatacccg gcgtgtgaaatgaaattcagcgaatttatcgcccttctgccaagcatacgcccgcgctattactcgatttc ttcatcacctcgtgtcgatgaaaaacaagcaagcatcacggtcagcgttgtctcaggagaagcgtgga gcggatatggagaatataaaggaattgcgtcgaactatcttgccgagctgcaagaaggagatacgatt acgtgctttatttccacaccgcagtcagaatttacgctgccaaaagaccctgaaacgccgcttatcatgg tcggaccgggaacaggcgtcgcgccgtttagaggctttgtgcaggcgcgcaaacagctaaaagaac aaggacagtcacttggagaagcacatttatacttcggctgccgttcaccatgaagactatctgtatca agaagcttgaaaacgcccaaagcgaaggcatcattacgctttcataccgcttttctcgcatgccaaa tcagccgaaaacatacgttcagcacgtaatggaacaagacggcaagaaattgattgaacttcttgatca aggagcgcacttctatatttgcggagacggaagccaaatggcacctgccgttgaagcaacgcttatga aagctatgctgacgttcaccaagtgagtgaagcagacgctcgcttatggctgcagcagctagaagaa aaaggccgatacgcaaaagacgtgtgggctggg |
| SEQ ID NO: 67 | IDP2, Candida (Amino Acid Seq.) | MGEIQKITVKNPIVEMDGDEMTRIIWQFIKDKLILPYLNVDLKYY DLGIEYRDQTDDKVTTDAAEAILKYGVGVKCATITPDEARVKEF NLKKMWLSPNGTLRNVLGGTVFREPIVIDNIPRIVPSWEKPIIIGR HAFGDQYKATDVVIPAAGDLKLVFKPKDGGEVQEYPVYQFDGR GVALSMYNTDASITDFAESSFQLAIERKLNLFSSTKNTILKKYDG KFKDIFEGLYASKYKTKMDELGIWYEHRLIDDMVAQMLKSKGG YIIAMKNYDGDVQSDIVAQGFGSLGLMTSVLVTPDGKAFESEAA HGTVTRHYRQHQQGKETSTNSIASIYAWTRGLVQRGKLDDTPE VVKFAEELEKAVIETVSKDNIMTKDLALTQGKTDRSSYVTTEEFI DGVANRLNKNLGY |

TABLE 40-continued

| SEQ ID NO: | Description | Sequence |
|---|---|---|
| SEQ ID NO: 68 | IDP2, Candida (Nucleic Acid Seq.) | atgggcgaaattcagaaaataacagtcaagaacccaatcgtcgaaatggacggtgacgaaatgaccc<br>gtatcatctggcaattcatcaaagacaagttgatcttgccttattttgaacgttgacttgaaatactacgactt<br>gggcatcgagtacagagaccagaccgacgacaaggtcaccaccgatgctgctgaagccatcttgaa<br>atacggtgtcggtgtcaagtgtgccaccatcaccccagacgaagccagagttaaagaattcaacttga<br>agaagatgtggctctctccaaacggtactttgagaaacgtccttggtggtactgtcttcagagaaccaat<br>tgtcattgacaacatcccaagaatcgtgcctagctgggaaaaaccaatcatcattggtagacacgctttc<br>ggcgaccaatacaaggccaccgacgtggttatcccagctgccggtgacttgaagttggtgttcaagcc<br>aaaagacggcggtgaagtgcaagaatacccagtctaccagttcgacggtcgaggtgtcgccttgagc<br>atgtacaacaccgacgcttcaatcactgatttcgctgaaagttccttccaattggccattgagcgtaaatt<br>gaacttgttttcttccaccaaaaacaccatcttgaagaaatacgacgggaaattcaaagacatattcgaa<br>ggcttgtacgccagcaaatacaagaccaagatggacgaattgggcatctggtacgagcacagattgat<br>tgacgatatggttgcacagatgttgaagtctaaaggtggttacatcatcgccatgaaaaactacgatggt<br>gatgtccaatccgacattgtcgcacaaggtttcggttccttgggtttgatgacctctgtgttttggttaccccca<br>gacggcaaggcttttgaatccgaggctgcccacggtactgtcactagacattatagacaacaccaaca<br>aggtaaagagacctcgaccaactccattgcctccatctacgcctggaccagagggttggtccaaaga<br>ggtaagttggatgacactccggaagttgtcaagtttgctgaagagttggaaaaggctgtcattgagact<br>gtctccaaggacaacatcatgaccaaagatttggccttgacccaaggtaagaccgacagatcttcgtat<br>gtcacgactgaagaattcatcgatggtgttgctaatagattgaacaaaaacttgggctac |
| SEQ ID NO: 69 | IDP3, Sc (Amino Acid Seq.) | MSKIKVVHPIVEMDGDEQTRVIWKLIKEKLILPYLDVDLKYYDL<br>SIQERDRTNDQVTKDSSYATLKYGVAVKCATITPDEARMKEFNL<br>KEMWKSPNGTIRNILGGTVFREPIIIPKIPRLVPHWEKPIIIGRHAF<br>GDQYRATDIKIKKAGKLRLQFSDDGKENIDLKVYEFPKSGGIA<br>MAMFNTNDSIKGFAKASFELALKRKLPLFFTTKNTILKNYDNQF<br>KQIFDNLFDKEYKEKFQALKITYEHRLIDDMVAQMLKSKGGFII<br>AMKNYDGDVQSDIVAQGFGSLGLMTSILITPDGKTFESEAAHGT<br>VTRHFRKHQRGEETSTNSIASIFAWTRAIIQRGKLDNTDDVIKFG<br>NLLEKATLDTVQVGGKMTKDLALMLGKTNRSSYVTTEEFIDEV<br>AKRLQNMMLSSNEDKKGMCKL* |
| SEQ ID NO: 70 | IDP3, Sc (Nucleic Acid Seq.) | atgagtaaaattaaagttgttcatcccatcgtggaaatggacggtgatgagcagacaagagttatttga<br>aacttatcaaagaaaaattgatattgccatatttagatgtggatttaaaatactatgacctttcaatccaaga<br>gcgtgataggactaatgatcaagtaacaaaggattcttcttatgctacccctaaaatatgggggttgctgtca<br>aatgtgccactataacaccccgatgaggcaagaaatgaaatttaaccttaaagaaagttgtgaaatctc<br>caaatgaacaatcagaaacatcctaggtggaactgtatttagagaacccatcattattccaaaaatacc<br>tcgtctagtccctcactgggagaaacctataattataggccgtcatgcttttggtgaccaatatagggcta<br>ctgacatcaagattaaaaagcaggcaaactaaggttacagtttagctcagatgacggtaaagaaaac<br>atcgatttaaaggtttatgaatttcctaaaagtggtgggatgcagtgcaatgtttaatacaaatgattcc<br>attaaaggggttcgcaaaggcatccttcgaattagctctcaaaagaaaactaccgttattcttacaaccaa<br>aaacactattctgaaaaattatgataatcagttcaaacaaattttcgataatttgttcgataaagaatataag<br>gaaaagtttcaggcttttaaaaataacgtacgagcatcgtttgattgatatatggtagcacagatgctaaa<br>atcaaagggcgggtttataatcgccatgaaaatttatgatggcgatgtccagtctgacattgtggcaca<br>aggatagggtctcaggataatgacgtccatatttgattacacctgatggtaaaacgatgaaagcgagg<br>ctgcccatggtacggtgaccagacatatagaaaacatcaaagaggcgaagaaacatcaacaaattca<br>atagcctcaatatttgcctggacaagggcaattatacaaagaggaaaattagacaatacagatgatgtta<br>taaaataggaaacttactagaaaaaggctactaggacacagacaagtgggcggaaaaatgaccaagg<br>atttagcattgatgcaggaaagactaatagatcatcatatgtaaccacagaagagatattgatgaagag<br>ccaagaggcttcaaaacatgatgctcagctccaatgaagacaagaaaggtatgtgcaaactataa |
| SEQ ID NO: 71 | GDP1, Kl (Nucleic Acid Seq.) | atgcccgatatgacaaacgaatcacactaagccagctcaaattaacattggtatcaatggattggtaga<br>atcggtagattggactacgtgctgcatgacgcacccagaagaaaggtcagattaatcaataatccatc<br>cacaacaccagaatacgctgcttatttgttcaaatacgattctactcacggcaagtatcgtggtgaagttg<br>aattcgacgatgaacgtatcatcattcaaaatgaccatgatcggctcatatccctctatctcatataggga<br>accagagcgtatcccatgggcacctacaacgtcgattatgtaattgactcaaccggtgtcacaaggaa<br>gtcgatacagcctctagacataaaggtgtcaaaagttatcattactgctccatcaaagaccgcgcca<br>atgtacgtctatggtgaaaccacgttaaatacaacccattgacggtcacgtggtctctaatgcctcctgt<br>actaccaactgtaggctccgaggaaaggctaggacgatgagacggtatcgaagaagccagatga<br>caactattcatgcaactactgcttctcaaaagactgtcgatggtaccagttctggtggtaaggactggag<br>aggcggtagatcagccagggaaatatcattccacatctactggtgcagctaaggctgtagggaaaat<br>cagcctgaacttaatggtaagatcaccggtatgtctataagagtcccaacaattaatatccctggaga<br>cttgacattccgtacagcaaagaaaacacttacgatgacattatgaaggccctagaacaaagatctcgc<br>agcgatatgaagggtgattgggtgaaccaaagacgccgagtgtcctctgacacacatccgattcacg<br>acatctattgagatgccaaggccggtattgaattgaacgaccattattcaaggtccatcaggtatgata<br>atgatggaactcacaagagtggagatttatccattacatggctcaaaaggacacgaagctggtgt<br>ttaa |
| SEQ ID NO: 72 | GDP1, Kl (Amino Acid Seq.) | MPDMTNESSSKPAQINIGINGFGRIGRLVLRAALTHPEVKVRLIN<br>NPSTTPEYAAYLFKYDSTHGKYRGEVEFDDERIIIQNDHVSAHIP<br>LSHFREPERIPWASYNVDYVIDSTGVFKEVDTASRHKGVKKVIIT<br>APSKTAPMYVYGVNHVKYNPLTDHVVSNASCTTNCLAPLVKAL<br>DDEFGIEEALMTTIHATTASQKTVDGTSSGGKDWRGGRSCQGNI<br>IPSSTGAAKAVGKILPELNGKITGMSIRVPTINISLVDLTFRTAKK<br>TSYDDIMKALEQRSRSDMKGVLGVTKDAVVSSDFTSDSRSSIVD<br>AKAGIELNDHFFKVLSWYDNEYGYSSRVVDLSIFMAQKDFEAG<br>V |

TABLE 40-continued

| SEQ ID NO: | Description | Sequence |
|---|---|---|
| SEQ ID NO: 73 | ZWF1, Candida (Nucleic Acid Seq.) | atgtatatgattcattcggtgactacgtcactatcgtcgattcggtgcaccggtgacaggccagcaaa aaaaccttccctgccttgtttggcttgtttagagaaaagcaattgccccaaccgtccagatcattggcta tgccagatcccatttgtccgacaaggacttcaaaaccaagatctcctcccacttcaagggcggcgacg aaaaaaccaagcaagacttcttgaacttgtgtacttatatcagcgacccatacgacactgacgatggtta caagagattggaagccgccgctcaagaatacgaatccaagcacaacgtcaaggtccctgaaagattg ttttacttggccttgcctccttctgtcttccacaccgtctgtgagcaagtcaagaagatcgtctaccctaag gacggtaagctcagaatcatcattgaaaagccgttcggacgtgatttggccacctaccgtgaattgcaa aagcaaatctccccattgttcaccgaagacgaactctacagaattgaccactacttgggtaaagaaatg gtcaagaacttgttggttttgagattcggtaacgaattgttcagtgggatctggaacaacaagcacatca cctcggtgcaaatctccttcaaggaaccctccggtaccgaaggtagaggtggctactttgacaacattg gtatcatcagagatgtcatgcaaaaccacttgttgcaagtcttgaccttgttgaccatgaaagaccagt ctcttttgacccagaagctgtcagagacgaaaaggtcaaggttttgaaagcttttgacaagattgacgtc aacgacgttcttttgggacaatacgccaagtctgaggatggctccaagccaggttacttggatgactcc accgtcaagccaaactccaaggctgtcacctacgccgcttttcagagtcaacatccacaacgaaagatg ggacggtgttccaattgattgagagccggtaaggctttagacgaaggtaaagttgaaattagaatccaa ttcaagccagttgccaaaggtatgtttaaggagatccaaagaaacgaattggttattagaatccaaccag acgaagccatctacttgaagatcaactccaagatcccaggtatctccaccgaaacttccttgaccgactt ggacttgacttactccaagcgttactccaaggacttctggatcccagaagcatacgaagccttgatcag agactgttacttgggcaaccactccaactttgtcagagacgatgaattggaagttgcttggaagctcttc accccattgttggaagccgttgaaaagaagacgaagtcagcttgggaacctacccatacggatccaa gggtcctaaagaattgagaaagtacttggtcgaccacggttacgtcttcaacgacccaggtacttacca atggccattgaccaacaccgatgtcaaaggtaagatctaa |
| SEQ ID NO: 74 | ZWF1, Candida (Amino Acid Seq.) | MSYDSFGDYVTIVVFGASGDLASKKTFPALFGLFREKQLPPTVQI IGYARSHLSDKDFKTKISSHFKGGDEKTKQDFLNLCTYISDPYDT DDGYKRLEAAAQEYESKHNVKVPERLFYLALPPSVFHTVCEQV KKIVYPKDGKLRIIIEKPFGRDLATYRELQKQISPLFTEDELYRID HYLGKEMVKNLLVLRFGNELFSGIWNNKHITSVQISFKEPFGTE GRGGYFDNIGIIRDVMQNHLLQVLTLLTMERPVSFDPEAVRDEK VKVLKAFDKIDVNDVLLGQYAKSEDGSKPGYLDDSTVKPNSKA VTYAAFRVNIHNERWDGVPIVLRAGKALDEGKVEIRIQFKPVAK GMFKEIQRNELVIRIQPDEAIYLKINSKIPGISTETSLTDLDLTYSK RYSKDFWIPEAYEALIRDCYLGNHSNFVRDDELEVAWKLFTPLL EAVEKEDEVSLGTYPYGSKGPKELRKYLVDHGYVFNDPGTYQ WPLTNTDVKGKI |
| SEQ ID NO: 75 | ZWF2, Candida Nucleic Acid | atgtcttatgattcattcggtgactacgtcactatcgtcgttttcggtgcttccggtgacttggccagaaaa aaaaccttccctgccttgtttggcttgtttagagaaaagcaattgccccaaccgtccagatcattggcta tgccagatcccatttgtccgacaaggacttcaaaaccaagatctcctcccacttcaagggcggcgacg aaaaaaccaagcaagacttcttgaacttgtgtctctatatgagtgacccatacgacaccgacgacgtt acaagaaattggaagccaccgctcaagaatacgaatccaagcacaacgtaaaggtcccagaaagatt gttctacttggccttgcctcctccgtcttccacaccgtctgtgagcaagtcaagaagctcgtctaccctc aggacggtaagctcagaatcatcattgaaaagccgtttggccgtgacttggccacctaccgtgaattgc aaaagcaaatctccccattgttcaccgaagacgaagtctacagaatcgaccactacttgggtaaagaa atggtcaagaacttgttggttttgagattcggtaatgaattgttcagtgggatctggaacaacaagcacat cacctcggtgcaaatttccttcaaggaacccttcggtaccgaaggcagaggtggctactttgacaacat tggtatcatcagagatgtcatgcaaaaccacttgttgcaagtcttgaccttgttgaccatgaaaagacca gtctcttttgacccagaagcagtcagagacgaaaaggtcaaggttttgaaagcttttgacaacattgacg tcaatgacgttcttttgggacaatacgccaagtccgaggatggctccaagccaggttacttggatgactc caccgtcaagccaaactccaaggctgtcacctacgccgcttcagagtcaacatccacaacgaaagat gggacggtgttccaattgtttgagagccggtaaggcttagacgaaggtaaagttgaaattagaatcca attcaagccagtcgctaaaggtatgtttaaggaaatccaaagaaacgaattggttattagaatccaacca gacgaagccatctacttgaagatcaactccaagatcccaggtatctccaccgaaacctccttgaccgac ttggacttgacttactccaagcgttactccaaagacttctggatcccagaagcatacgaagccttgatca gagactgttacttgggcaaccactccaactttgtcagagacgatgaattggaagttgcttggaagctctt caccccattgttggaagccgttgaaaagaagacgaagtcagcttgggaacctacccatacggatcca agggtcctaaagaattgagaaagtacttggtcgaccacggttacgtcttcaacgacccaggtacttacc aatggccattgaccaacaccgatgtcaaaggtaagatctaa |
| SEQ ID NO: 76 | ZWF2, Candida (Amino Acid Seq.) | MSYDSFGDYVTIVVFGASGDLARKKTFPALFGLFREKQLPPTVQI IGYARSHLSDKDFKTKISSHFKGGDEKTKQDFLNLCSYMSDPYD TDDGYKKLEATAQEYESKHNVKVPERLFYLALPPSVFHTVCEQ VKKLVYPKDGKLRIIIEKPFGRDLATYRELQKQISPLFTEDEVYRI DHYLGKEMVKNLLVLRFGNELFSGIWNNKHITSVQISFKEPFGT EGRGGYFDNIGIIRDVMQNHLLQVLTLLTMERPVSFDPEAVRDE KVKVLKAFDNIDVNDVLLGQYAKSEDGSKPGYLDDSTVKPNSK AVTYAAFRVNIHNERWDGVPIVLRAGKALDEGKVEIRIQFKPVA KGMFKEIQRNELVIRIQPDEAIYLKINSKIPGISTETSLTDLDLTYS KRYSKDFWIPEAYEALIRDCYLGNHSNFVRDDELEVAWKLFTPL LEAVEKEDEVSLGTYPYGSKGPKELRKYLVDHGYVFNDPGTYQ WPLTNTDVKGKI |
| SEQ ID NO: 77 | PGI1, Candida Nucleic Acid | atgtccactttcaagttagccaccgaattgccagaatggaaaaaattggaacaaacctacaagtccgtg ggtgaaaagttcagcgtcagagatgccttcgctaacgacaagaacagattcgaagagtctcctggat ctaccaaaactacgacgactccaagatcttgtttgatttctccaagaacttggtcaacaaggagatcttgg accaattgatcaccttggccaaagaagctggtgtcgagaaattgagagacgctatgtttgctggtgatc acatcaacaccaccgaagacagagccgtgtaccacgttgccttgagaaaccgtgccttgagaaaaat |

TABLE 40-continued

| SEQ ID NO: | Description | Sequence |
|---|---|---|
| | | gccagtcgacggtaaggacaccgccaaggaagttgacgacgtcttgcaacacatgaaggaattctcc<br>gactccatcagagacggctcttggaccggttacactggtaaggccatcaccgatgttgtcaacattggt<br>attggtggttccgacttgggtccagtcatggttactgaagccttgaaggcctacagcaagccaggcttg<br>aacgtccactttatctccaacattgacggtacccacacccacgaaaccttgaagaacttgaacccagaa<br>accaccttgttcttggttgcttccaagaccttcaccaccgctgaaaccatcaccaacgccacctccgcca<br>aaaactggttcttagctgccgctaaggatccaaagcacattgccaagcatttcgctgcttgtctccaccaa<br>cgaagctgaggttgaaaaattcggtatcgacgtcaagaacatgtttggtttcgaaagtttgggtcggtggt<br>cgttactctgtctggtccgccattggtttgtctgtcgccatctacattggtttcgaaaacttcaacgacttctt<br>gaagggtggtgaagccatggaccaacacttttttgaccactcctttggaaaacaacatcccagtcattgg<br>tggtttgttgtctgtctggtacaacaacttcttttggtgctcaaacccacttggttgttccattcgaccaatact<br>tgcacagattcccagcttacttgcaacaattgtctatggaatccaacggtaagtctgtcactagagccaa<br>cgtcttcaccaactaccaaaccggtaccatcttgtttggtgagccagccaccaacgcccaacactcctt<br>cttccaattggtgcaccaaggtaccaagttgatcccagctgacttcatcttggctgctcaatcccacaac<br>ccaattgaaaacaacttgcaccaaaagatgttggcctccaacttctttgctcaatccgaagctttgatggt<br>tggtaaggacgaagccaaggttaaagccgaaggtgccactggtggtaggttccacacaagaaattct<br>ctggtaacagaccaaccacctccatcttggctcaaaagatcaccccagccgctttgggttctttgattgc<br>ctactacgaacacgttacttcaccgaaggtgctatctggaacatcaactattcgaccaatggggtgttg<br>aattgggtaaggttttggctaaggtcattggtaaggaattggatgacaagtccgctgttgttacccacgat<br>gcctccaacaaccggtttgatcaaccaattcaagaaatgggaagcttga |
| SEQ ID NO: 78 | PGI1, Candida (Amino Acid Seq.) | MSTFKLATELPEWKKLEQTYKSVGEKFSVRDAFANDKNRFEEFS<br>WIYQNYDDSKILFDFSKNLVNKEILDQLITLAKEAGVEKLRDAM<br>FAGDHINTTEDRAVYHVALRNRALRKMPVDGKDTAKEVDDVL<br>QHMKEFSDSIRDGSWTGYTGKAITDVVNIGIGGSDLGPVMVTEA<br>LKAYSKPGLNVHFISNIDGTHTHETLKNLNPETTLFLVASKTFTT<br>AETIITNATSAKNWFLAAAKDPKHIAKHFAALSTNEAEVEKFGID<br>VKNMFGFESWVGGRYSVWSAIGLSVAIYIGFENFNDFLKGGEA<br>MDQHFLTTPLENNIPVIGGLLSVWYNNFFGAQTHLVVPFDQYLH<br>RFPAYLQQLSMESNGKSVTRANVFTNYQTGTILFGEPATNAQHS<br>FFQLVHQGTKLIPADFILAAQSHNPIENNLHQKMLASNFFAQSEA<br>LMVGKDEAKVKAEGATGGLVPHKEFSGNRPTTSILAQKITPAAL<br>GSLIAYYEHVTFTEGAIWNINSFDQWGVELGKVLAKVIGKELDD<br>KSAVVTHDASTNGLINQFKKWEA |
| SEQ ID NO: 79 | ACS2A, ATCC20336 (Nucleic Acid Seq.) | atgccagcattattcaaagattctgcccaacacatacttgacaccatcaagtctgaactcccacagatcc<br>cctcaaaaccgcatatgctgtgccgcttgaaaattcagccgaaccaggctactctgccatctacagaaa<br>caaatactccatcgataagaaattgataccccataccccggcaggacaccagtacaagagatgagg<br>ttgccactgaagcatacggtgataaaccatgtcttggtgccagagtcaagaacgccgatggcacctttg<br>gagaatacaagttccaagactacaacaccattcaccaaagaagaacaacacgggtcaggtattactt<br>tgtcttacagaacaaaccatacaagaccgattctgaagcccactccaagttgaagtacgacccaacaa<br>gcaaggattccacatcagacaatcacagtcacaacgtcctgaatgggccagtgtgatagaccagt<br>attgcctaaccatcaccaacaccgctagtacgacactagggtcccgacaccagtaagtacattaggg<br>tagactgagtcgccaattgtcatctgaccaaggataagattagaggtcttattgacttgtaagaagaaca<br>acccagacgaattgtccaacttgattgattagtgtccatggatgacagatcaccgctgatgcctcatga<br>agaactacggtagtgaacacaacgtcactgatagacatcaagcaggagagaaaagggtgagatca<br>acccattggacccaatcgagccaaccccagacaccaatacaccattactacacctctggtaccaccg<br>gtgctaacccaaaggtgtcttgttgaaccacagaaacgctgtcgctggtgtcacttttttgtgctcagtag<br>atacgatggccatttcaacccaacagcttaactaccacccaggccacatttacgaaagagctagcat<br>ccagtagcattgactatcggaccgccattggattcccacaaggtccatctccattgactagattgaaga<br>tgccaaggtgttgcaaccagacggtaggctaggacctagagtcagaccaagaggaagctgccatc<br>agggcacaaactgtcaacaatgacgaaaaaccattggaaaatcggtctaggagctgctatcaacgcc<br>aagatggaagcacaaatgaaagaaagaaaacgaaaacaacccaagatcattgtctatgatcgtagt<br>tgaacttgttgagaaagaaggttggtttgcaaaaagttacccaaatcagtaccggaagtgctccaatctc<br>tccatcaactattcaattcagaaagcaccagaatgtcggtatcttgcaaggaacggatgagtgaatca<br>tttgctggatgtatggcttcttccaaattcgaaccagcggcagccacttgtggtcctactggtgtcaccac<br>tgaagtcaagagaaggtcagaaaatggtcaacaccaaggatgaaggtggtccaagaggtg<br>agaattattgagaggtccacaaatcacaagggatatacaagaaccctgaggaaactgccaaggccat<br>tgacgaagatggaggaccatactggtgatgagccaagatcaacgacaaaggcagaataccatcatt<br>gatagagcaaagaatttcttcaaattggctcaaggtgaatacgttaccccagagaaaatcgaaggtttgt<br>acagtccaagaccccatacattgcccaattatagtccatggtgactctaaggaatcgtacaggagggtg<br>tgtcggattagacccagttgctggtaagcagtacatggagtcgagattccacgacaagatcatcaagg<br>aagaggacgagagacacaagtccccaagaaacagaaagatatagtgcaagacatgaacaag<br>ctgattgctgaccaattgcaaggattgagaagagcacaacatctacgagactagaccattgacggt<br>cgaaagaggcgtcattactccaaccgaatgatcagaagaccacttgctgccaagacaccaggatca<br>aatcgatgctatgtacgaaggatcattggttagaaatggttctttgtag |
| SEQ ID NO: 80 | ACS2A, ATCC20336 (Amino Acid Seq.) | MPALFKDSAQHILDTIKSELPLDPLKTAYAVPLENSAEPGYSAIY<br>RNKYSIDKLIDTPYPGLDTLYKLFEVATEAYGDKPCLGARVKNA<br>DGTFGEYKFQDYNTIHQRRNNFGSGIFFVLQNNPYKTDSEAHSK<br>LKYDPTSKDSFILTIFSHNRPEWALCDLTSIAYSITNTALYDTLGP<br>DTSKYILGLTESPIVICSKDKIRGLIDLKKNNPDELSNLIVLVSMD<br>DLTTADASLKNYGSEHNVTVFDIKQVEKLGEINPLPIEPTPDTN<br>FTITFTSGTTGANPKGVLLNHRNAVAGVTFVLSRYDGHFNPTAY<br>SFLPLAHIYERASIQFALTIGSAIGFPQGPSPLTLIEDAKVLQPDGL<br>ALVPRVLTKLEAAIRAQTVNNDEKPLVKSVFGAAINAKMEAQM<br>KEENENFNPSFIVYDRLLNLLRKKVGLQKVTQISTGSAPISPSTIQ<br>FLKASLNVGILQGYGLSESFAGCMASSKFEPAAATCGPTGVTTE |

TABLE 40-continued

| SEQ ID NO: | Description | Sequence |
|---|---|---|
| | | VKLKDLEEMGYTSKDEGGPRGELLLRGPQIFKGYFKNPEETAKA<br>IDEDGWFHTGDVAKINDKGRISIIDRAKNFFKLAQGEYVTPEKIE<br>GLYLSKFPYIAQLFVHGDSKESYLVGVVGLDPVAGKQYMESRF<br>HDKIIKEEDVVEFFKSPRNRKILVQDMNKSIADQLQGFEKLHNIY<br>VDFDPLTVERGVITPTMKIRRPLAAKFFQDQIDAMYSEGSLVRN<br>GSL* |
| SEQ ID NO: 81 | ACS2B, ATCC20336 (Nucleic Acid Seq.) | atgacatcgacacagagtatcttctccggcgagaagtacactaaggaagaagcgttagcacaattacc<br>tttcgggagtgctgttgagaatgctgtcgctataaacgagccagttacaaaccccaagtattctgcaatct<br>tcagaaatgcagcccatctcgaccgcatggttcagaacgtgcaccctgatttaaacacccactacaag<br>ctcttcaacaatgctgctgagatgtaccgtgaccgtcatgtcttggtaagcgtccataacactacacca<br>cacaccaactggatgattacttcctgcactggacgtatggtgaggtctttacgaagaagaataacattgg<br>tgctgggttattcgcgcgttattggagaaccttcctgacgtgacgttggagtcgcataggaagattg<br>tcaatcatttacgtgactggcccactttcggcatcaacaatcaccaagggagaacttgaactatgagat<br>tgagaagaattgttcgttcattttgactattttgccgtcaatcgtgctgaatggatcttgactgatttggcat<br>gcagttcgtatgcaatcacaaacaccgcgttgtatgatacattaggtcccgacgtgtctcagtatatcttg<br>aacttgactgaatcaccaattgtcgtttgcacccatgacaagatccaggttttgttgaacttgaaaagaaa<br>gtaccctgagcagacaagaacttgatttctatcgtgtcaatggaccaattgatttagtcacgcaggga<br>acaatcgaacaagcttatgagttgggggtcacaattcaaggtttgaatcagattgagaaaattggtgttct<br>gaacccaattcaacaattggaaactggtacagaagctttgtttaccattcattcacttcaggaactactg<br>gtagtaaacccaaaggagtgatgatttctcaaggtggtgctgctgcctacgtcacgtgggggttgagct<br>gttgtccacaggctaaacctggtgataaggcgtatattcttgccgttgactcatttgtatgaaagagaa<br>cttgtcgctttgcctatagttctgggtactatttgggttcccgcagattaacctaggcaaaagaaggtg<br>aatccttttgagaacatgcttaacgatttgagaatcttcaaaccaacatatatgtccatggttcctagattatt<br>gaccaggttggaagcgttgatcaagagtaagatcaaggagttgccacaagctgaccaggacagagt<br>gaatggtataattgagatcaagataagggagcaaagcaaggctgacggcgccaaagggtttgacgc<br>aaccttggacaacgaccctacctacaaatcattagctaagtttgttgggtatgaaaacatgagatgggtt<br>cagactgcaagtgcaccaattgcccccaccacacttgtctactttgaaagcgtctttgaacatcggtgcc<br>agacaacaatacgggttgactgaaagtggggccgccatcacaagtaccggggagtacgaagcatcc<br>ccaggaggtgtggtgttgtattaccaactgggcagtgccgactctactccgtttccgagatgggtact<br>ccttggacaaattagaaggcgaggtgttgctccagggccacagatgttcaaagggtactactacaac<br>tacgaggaaaccgagaatgcagttactgaacgggatggttccattcaggagacattgctcgggttga<br>ccccgcgacaggtcgcctcgacataattgaccgagtcaagcatttctttcaaattggctcagggagagta<br>catctccccagagcgtatcgagaacaggtacttgtcgtcgaacccagacatctgccagctctgggtgc<br>acggggactctaaggagcactacttgattggcatagtgggggtgagtacgaaaaaggattgaagttt<br>atcaatgaggagtttggatataacaagattgacatgcagccggatgatagttggacattttgaactcggc<br>ggaggtgaaggcacggttcttgagcaagctaaatagactggttaaagataagttgaacgggtttgagat<br>cttgcataatatctttattgagtttgagccgttgacggtccagagagaagttgttactccgacattcaaaatt<br>agaagaccaatctgtcgtaagttcttcaaggcccagcttgatgcgatgtacgccgaggggtccttaatc<br>agcgctgccaagttgtag |
| SEQ ID NO: 82 | ACS2B, ATCC20336 (Amino Acid Seq.) | MTSTQSIFSGEKYTKEEALAQLPFGSAVENAVAINEPVTNPKYSA<br>IFRNAAHLDRMVQNVHPDLNTHYKLFNNAAEMYRDRPCLGKR<br>PYNYTTHQSDDYFSHWTYGEVFTKKNNIGAGFIRALLENPFLDV<br>TLESHRKIVNHLRDWPTFGINKSPRENLNYEIEKNCSFILTIFAVN<br>RAEWILTDLACSSYAITNTALYDTLGPDVSQYILNLTESPIVVCT<br>HDKIQVLLNLKRKYPEQTKNLISISVSMDPIDLVTQGTIEQAYELG<br>VTIQGLNQIEKIGVSNPIQQLETGTEALFTISFTSGTTGSKPKGVMI<br>SQGGAAAYVTWGLSCCPQAKPGDKAYIFLPLTHLYERETCAFA<br>YSSGYYLGFPQINLGKKKVNPFENMLNDLRIFKPTYMSMVPRLL<br>TRLEALIKSKIKELPQADQDRVNGIIEIKIREQSKADGAKGFDATL<br>DNDPTYKSLAKFVGYENMRWVQTASAPIAPTTLVYLKASLNIG<br>ARQQYGLTESGAAITSTGEYEASPGGCVVLPTGQCRLYSVSEM<br>GYSLDKLEGEVLLQGPQMFKGYYYNYEETENAVTEDGWFHSG<br>DIARVDPATGRLDIIDRVKHFFKLAQGEYISPERIENRYLSSNPDI<br>CQLWVHGDSKEHYLIGIVGVEYEKGLKFINEEFGYNKIDMQPDD<br>LLDILNSAEVKARFLSKLNRSVKDKLNGFEILHNIFIEFEPLTVQR<br>EVVTPTFKIRRPICRKFFKAQLDAMYAEGSLISAAKL* |
| SEQ ID NO: 83 | ACS2C, ATCC20336 (Nucleic Acid Seq.) | atgtccaccttattcaacgagccacctgaacagatctaccagagtctcttgactcagtacaacaacccac<br>tcgattacgcatccagtgttgcactcccaaatacgcaagaaccgggatattcatctatctacaggaatgt<br>gtttgatcccagtaagcttgttacctgtccacatcccgagttagcacgttgtacaaaattttttgagttcagt<br>gttattgtttacggagacaagccgttccttggccaccggatcaaaaacccagatggtacctttggcgagt<br>acacgtttgaaacttacaagcaggtctatgaaagaagaaacaattcttggttctggtattactacgtcttg<br>gaaaacagtccataccggacctcatccgaagctcatgcgaaattaaagtatgaccctaccaacgacaa<br>cccattcattttggcgcttttcagtcataatcgtccagaatgggcattgtgtgatgtcacaaccagtgcttat<br>ggtttcatcaacactgcattgtacagcacccttgggtccagataccagcagatacatcttgtctgtcaccg<br>attgtccaattgtagttgccacgaaggacaagattgaagggtttgatcaacttgaagatggatgaaaaatccca<br>aagacttggtcaacttgattgttcttgtttcattagatgaacttaccgttgaagacgataagttgagatcatt<br>gggtcgtgaaaacaacattgtgtttatgctttgaaggaagttgaaagactcggtgcagctaacccattg<br>gcaccaattgctccaaccccagacactgtcttcacgatttcgtttacttcgggtaccagcggagcagca<br>cctaaaggtgttgttgacaaatagaatcgttggcttgcggaatagcatcccattgttctctcgttgggttt<br>ggtcctgaccgtgtcgagtacagtttcttgcctcatatctacgagagaatggtgcttcagtttgga<br>ataatagctggagtgaagatcgggtatccacagggtccttctccaacaaccttgtttgaagacatcaag<br>gttttgcaaccaacgatgttgtgtttggttcccagagtattcacgaagatagaagctgccatcaaggccc<br>agacagttgaaaatgaatcagatccagaactcagagctaagtttatcgaaataatcaacaagaaagtgg<br>agttgcaacaacaacaggactttacaaatccaagtctcccagaaggtgacaagctcttacaacaattgc |

TABLE 40-continued

| SEQ ID NO: | Description | Sequence |
|---|---|---|
| | | gtgagacccttggaatgggtaaacttcaattcatgaacactggatcagctccactgtcagaggagtctta<br>tcgtttatccaagctgtgatgaacatgcctaatgggttccgttgtggttacggtttgacagaaagcgctg<br>ctggtcttgcaatctccccaccatacgccaatgaattctcatgtgggcccatttcccagaccaccgagttt<br>agattgaaagatcttgttgatatgggttacacttcgaaagataaagagggagtaaggggtgaattgttatt<br>gagaggtcctcaaatcttctcttactactacaagaacccagaggagacggccaaggctatagacaagg<br>acggatggttccatactggtgatgtggcttctctcaccgaagcacatggaaacagctttcagattatcga<br>cagagccaagaacttcttcaagttgtcccaaggagagtatgtgtctccagagaagattgaaaatgtgta<br>catgggctcagtttccgttcatccgcagttgtttgttcatggagattcattggagtcatatttggttggtgtcg<br>ttggaatcgacaaagcattggttgatccttatttgaagaaacgcttcaacgtggagttggacacaccagc<br>tgagatcttcaagttttttgagaacccacgaacagaaagacattgttgcaagacatgaacaaggcggt<br>tggtagtgagttgcaaggattcgaaaaattgcataatgatttgttgattttgaaccattgacccttgagaga<br>ggagttattacgccaactgtcaagatcagaagagctaactgtgtcaacttcttaagcagcacatccaaa<br>gtatgtatggcgaaggatctttgctcaagaatagtaacttatag |
| SEQ ID NO: 84 | ACS2C, ATCC20336 (Amino Acid Seq.) | MSTLFNEPPEQIYQSLLTQYNNPLDYASSVALPNTQEPGYSSIYR<br>NVFDPSKLVTCPHPELDTLYKIFEFSVIVYGDKPFLGHRIKNPDG<br>TFGEYTFETYKQVYERRNNLGSGIYYVLENSPYRTSSEAHAKLK<br>YDPTNDNPFILALFSHNRPEWALCDVTTSAYGFINTALYSTLGPD<br>TSRYILSVTDCPIVVATKDKIEGLINLKKKNPKDLVNLIVLVSLDE<br>LTVEDDKLRSLGRENNIVVYALKEVERLGAANPLAPIAPTPDTV<br>FTISFTSGTSGAAPKGVVLTNRILACGIASHCSLVGFGPDRVEYSF<br>LPLAHIYERMVLQFGIIAGVKIGYPQGPSPTTLFEDIKVLQPTMLC<br>LVPRVFTKIEAAIKAQTVENESDPELRAKFIEIINKKVELQQQQDF<br>TNPSLPEGDKLLQQLRETLGMGKLQFMNTGSAPSSEESYRFIQA<br>VMNMPNGFRCGYGLTESAAGLAISPPYANEFSCGPISQTTEFRLK<br>DLVDMGYTSKDKEGVRGELLLRGPQIFSYYYKNPEETAKAIDK<br>DGWFHTGDVASLTEAHGNRFQIIDRAKNFFKLSQGEYVSPEKIE<br>NVYMAQFPPISQLFVHGDSLESYLVGVVGIDKALVDPYLKKRFN<br>VELDTPAEIFKFFENPRNRKTLLQDMNKAVGSELQGFEKLHNVF<br>VDFEPLTLERGVITPTVKIRRANCVNFFKQHIQSMYGEGSLLKNS<br>NL* |
| SEQ ID NO: 85 | CAT2, ATCC20336 (Nucleic Acid Seq.) | atgtttaactttaagttgtcgcaacaagtattaaagaattccaccaaatccattatgccaattttgaaaaaac<br>cattctccaccagccacgcaaagggtgacttgttcaaataccagtcacaattacccaagttgcctgttcc<br>tacttggaagaaaccgatcatccaagaccgttgagccattcttgaaccaagagcaattgga<br>atccaccaaggccaaagtcgctgagtttgttagaccaggtggtgccggtgaagccttgcaagcagat<br>gaacaactttgccgccgacaaggacaactggttggctgaattttgggacgactatgcatacatgtctta<br>tagagatcctgttgttccatatgtttcttacttttcagtcacaaggatgtcaagaacatcattggccaagac<br>caattgttgaaggccacttttgattgcttactacactattgagttccaagaaaaggtttcggacgaaagttg<br>gacccagaagtcatcaagggtaaccattctgtatgaacgccttcaagtacatgttcaacaactcgaga<br>gttccagctgaaggctccgacatcacccaacactacaacggtgaagaaaaccaattttttcgttgtcatct<br>acaagaacaacttctacaaggttccaacccacaagaacggccaaagattgaccaagggtgaaatcta<br>cagctacttgcaagaaatcaagaacgatgccactccaaagggtctcggtttgggtgcttttgacctcattg<br>aacagagacgaatggttgagtgcctacaacttgttgaagtccccaatcaacgaagcttccttggga<br>tccatattgcttccagctttgtcattgcctggactccaacaacccagtcaccattgaagaaaaatccaa<br>gaactgctggcacggggacggtcaaaacagattctttgacaagcctttggaattcttcgtcagtgctaac<br>ggtaactctggtttccttggtgaacactccagaatggacgctaccccaaccgtgcaattgaacaacacc<br>atctacaagcaaatcttggaaaccaatccaaacgacttgattgttgaaattggttcttctgctccaagattc<br>ggcaatggcgaaatcttgcattcgacatcaaccaccagagccaacatcaaagacgctattgcc<br>aagtttgacgccaccattgctgcccacgacgaagaaatcttccaacactacggttacggtaagggattg<br>atcaagaagttcaaggtctcccagatgcctacgtgcaattgttgatgcaattggcatacttcaagtaca<br>ccggcaagatcagaccaacttatgaatccgccgccaccagaaagttcttgaagggtagaaccgaaac<br>cggtagaactgtctccaacgaatccaagaagtttgttgagacctggtccgatccaaaggccagcagcg<br>ccgacaaggttgccacttccaagctgctgctaagcaacacgttgcctatttgtctgctgctgccgatgg<br>taagggtgttgaccgtcacttgtttggtttgaagcaaatgattcaaccaggcgaaccaatccctgaaatct<br>tcactgacccaatcttcagctattctcaaacctggtacatttcttcttcccaagttccatctgaattcttccaa<br>tcttggggttggtcgcaagtcattgatgacggtttcggtttggcttacttgatcaacaacgactggatcca<br>cgttcacatttcttgtaagagaggcaacggcttgcaatctgaccacttgaaatggtacttggttgaaagtg<br>ctaatgaaatgaaggatgttttgactaagggattattgactgatgctaagcctaagttgtaa |
| SEQ ID NO: 86 | CAT2, ATCC20336 (Amino Acid Seq.) | MFNFKLSQQVLKNSTKSIMPILKKPFSTSHAKGDLFKYQSQLPKL<br>PVPTLEETASKYLKTVEPFLNQEQLESTKAKVAEFVRPGGAGEA<br>LQARLNNFAADKDNWLAEFWDDYAYMSYRDPVVPYVSYFFSH<br>KDVKNIIGQDQLLKATLIAYYTIEFQEKVLDESLDPEVIKGNPFC<br>MNAFKYMFNNSRVPAEGSDITQHYNGEENQFFVVIYKNNFYKV<br>PTHKNGQRLTKGEIYSYLQEIKNDATPKGLGLGALTSLNRDEWL<br>SAYNNLLKSPINEASLGSIFASSFVIALDSNNPVTIEEKSKNCWHG<br>DGQNRFFDKPLEFFVSANGNSGFLGEHSRMDATPTVQLNNTIYK<br>QILETNPNDLIVEIGSSAPRFGNAEILPFDINPTTRANIKDAIAKFD<br>ATIAAHDEEIFQHYGYGKGLIKKFKVSPDAYVQLLMQLAYFKYT<br>GKIRPTYESAATRKFLKGRTETGRTVSNESKKFVETWSDPKASS<br>ADKVATFQAAAKQHVAYLSAAADGKGVDRHLFGLKQMIQPGE<br>PIPEIFTDPIFSYSQTWYISSSQVPSEFFQSWGWSQVIDDGFGLAY<br>LINNDWIHVHISCKRGNGLQSDHLKWYLVESANEMKDVLTKGL<br>LTDAKPKL* |

TABLE 40-continued

| SEQ ID NO: | Description | Sequence |
| --- | --- | --- |
| SEQ ID NO: 87 | CROT (Amino Acid Seq.) | MPQEDYSDIVSEATEFVSSSLINLIQRHLEAVAEREEFSNYLNVV NNDMTPSIYGEIRGDILPRNPYLILEEDPYSKTINPPNQAQRAANL INSSLKFIITLRNETLKPDVTPKHGNPLTMKCYRNLFGTTRIPEFE EHNHDIKMRKYEHINDSRHILIIANNQFYTLEVITEYTEEEYQETK SKHKIWFNDHELSLILQQIIDESKKVDAVKSINNSIGSLTTQTLKH WKLARLELEQSNLENIKKIDDALFVVILDSNAPETDGEKTAVISH GTSVLSADNVQVGTCTSRWYDKLQLIVTQNSVAGVVWESMSM DSTAILRFISDIYTDSVLKLAKNINGSEYTLFDSNIVFASSSISKPE AVMIYFNKTKELQNIIHLSETRLADLINQHEYMTHRIKLDSYLTS KFNLSVDSIMQVCFQIAYYSLYGRVVNTLEPITTRKFKDARTELI PVQNEVLGNLVKLYITSASALEKFEAFKKCCELHTHQYHDAMIG KGFERHLMTIIQVIKKPKAVVRLNELNSHLPPIPDLTKEPVTIPLL LNPAIDKLLSPELLISNCGNPALRLFGIPPAIDQGFGIGYIIHRDKV LITVCSKHRQTERFLDTFHRVVRDLKVNLRQKSNFLXXXXSVTR NKENTSCRGCESSMS |
| SEQ ID NO: 88 | CROT (Nucleic Acid Seq.) | atgccgcaggaggactactcagacatcgtgagcgaggccaccgagtttgtctctagcagcttgatcaa cttgatccagcggcacttggaagctgttgctgagagagaggagttctcaaactacttgaacgtcgtcaa caatgacatgactccgtccatctacggtgagattaggggtgacatattgcccagaaaccgtaccttatc ttggaagaagaccgtacagcaagacgatcaacccaccgaaccaggcccagagagcagccaactt gatcaactcgagtttgaagttcattattacgttgaggaacgagacgttgaagccagatgtcactccaaag cacggaaacccgttgacgatgaagtgctacaggaacttgtttggcacgacgaggatcccggaatttga agagcacaaccacgacatcaagatgagaaagtacgaacacatcaacgactcacgcacattttgatta tcgccaacaaccagttctacacattggaagtgatcacggagtacacagaggaggagtaccaggagac caagtccaagcacaagatctggttcaatgaccatgagcttcgttgatcttgcacgcaaatcatagacgag tccaagaaggttgacgccgtcaagtccatcaacaactccattgggtcgttgaccacgcagacgttgaa gcattggaagttggctaggtggagttggagcagtcgaatctggaaaacatcaagaagattgacgatg cgttgtttgtcgtgatttttggactctaacgcaccagaaactgacggagagaaaacggcggtgatttccc acggtacgtccgtgttgtcagcggacaacgtgcaggttggtacctgtacctcgcgttggtacgataagt tgcagttgattgtcacccagaactccgttgctggtggtggtaatccatgctgcgatggacagtactgc tattttgagattcatcagtgatatctacaccgactcggtgttgaagttggccaagaacatcaacgggtcc gagtacactttgtttgactccaatattgtgtttgcgtcttcttcaatcagcaagccggaagccgtcatgatct attccaacaaacaaaggagttgcagaacattatccatctttcggaaaccagattggctgacttgatcaa ccaacacgagtcatgacgcaccgtatcaagttggattcgtacttgacgagcagtttaaccttccgtg gactccatcatgcaggtgtgtttccagattgcttattactcgtgtacggtagagttgtcaacacgttggag ccaatcaccaccagaaaattcaaggacgccagaacgagttgatcccggttcagaatgaagttcttgg caacttggtcaagctctacatcaccagcgccagtgcactggagaagtttgaagcattcaagaaatgttg tgagttgcacacccaccagtaccacgatgccatgattggtaaaggtttcgaaagacacttgatgacgat catccaagtgatcaagaaaccgaaagctgtggtcagattaaacgaacttaacagccacttgccgccaa ttcctgacttgaccaaggaaccagtgaccattccgttattgctaaacccagccattgacaagttactgag ccccgagttgttgatttccaactgcggtaatcctgcattgagattgtttggtatcccgccagccatcgacc aagggtttggtattgggtacattatccaccgcgacaaggtgttgatcactgtttgttccaagcacagaca aacggaaaggttcttggacacttttccaccgtgttgttcgtgatttgaaggtcaacttgagacaaaagagc aacttttttgnnnnnnnnnnngatcagtgactcggaacaaagaaaacacgagttgcagaggttgcgaat cgagcatgagt |
| SEQ ID NO: 89 | FAT1, ATCC20336 (Nucleic Acid Seq.) | atgtcaggattagaaatagccgctgctgccatccttggtagtcagttattggaagccaaatatttaattgc cgacgacgtgctgttagccaagacagtcgctgtcaatgccctcccatacttgtggaaagccagcagag gtaaggcatcatactggtactttttcgagcagtccgtgttcaagaacccaaacaacaaagcgttggcgtt cccaagaccaagaaagaatgccccaccccaagaccgacgccgagggattccagatctacgacg atcagtttgacctagaagatacacctacaaggaattgtacgacatgtggattgaagtactcatacatcttg aagaacgagtacggcgtcactgccaacgacaccatcggtgtttcttgtatgaacaagccgcttttcattg tcttgtggttggcattgtggaacattggtgccttgcctgcgttcttgaacttcaacaccaaggacaagcca ttgatccactgtcttaagattgtcaacgcttcgcaagttttcgttgacccggactgtgattcccaatcaga gataccgaggctcagatcagagaggaattgccacatgtgcaataaaactacattgacgagtttgccttg tttgacagattgagactcaagtcgactccaaaacacagagccgaggacaagaccagaagaccaacc gatactgactcctccgcttgtgcattgatttacacctcgggtaccaccggttttgccaaaagcggtatcat gtcctggagaaaagccttcatggcctcggttttctttggccacatcatgaagattgactcgaaatcgaac gtcttgaccgccatgccttgtaccactccaccgcgcatgttggggttgtgtcctactttgattgtcgg tggctgtgtctccgtgtcccagaaattctccgctacttcgttctgaccaggccagattatgtggtgcca cccacgtgcaatacgtcggtgaggtctgtcgttacttgttgaactccaagcctcatccagaccaagaca gacacaatgtcagaattgcctacggtaacgggttgcgtccagatatatggtctgagttcaagcgcagat tccacattgaaggtatcggtgagttctacgccgcgcaccgagtccccttatcgccaccgcccaaccttgcagt acggtgagtacggtgtcggcgcctgtcgtaagtacgggtcccctcatcagctcgtcttattgtctacccagca gaaattggccaagatggaccagaagacgagagtgaaatctacaaggaccccaagaccgggttctg taccgaggccgcttacaacgagccaggtgagttgttgatgagaatcttgaaccctaacgacgtgcaga aatccttccaggggttattatggtaacaagtccgccaccaacagcaaaatcctcaccaatgttttcaaaaa aggtgacgcgtggtacagatccggtgacttgttgaagtaggacgaggacaaattgttgtacttttgtcga cagattaggtgacactttccgttggaagtccgaaaacgtctccgccaccgagtcgagaacgaattga tgggctccaaggccttgaagcagtccgtcgttgtcggtgtcaaggtgccaaaccacgaaggtagagc ctgttttgtctgtgaagccaaggacgaggttgagccatgaagaaatcttgaagtttgattcactctcac gtgaccaagtcatgcctgtgtatgctcaacctgcgacatcaagattggcaccattgaggcacgcacaa ccacaaggacctaagaaccaattcaagaaccaaaagagccaaagggtgaagacggcaaggatag atctactggagaatggcgacaagtaccaggagagactgaagacgattggtcatgatagtaccggta aagccaaattgtag |

TABLE 40-continued

| SEQ ID NO: | Description | Sequence |
|---|---|---|
| SEQ ID NO: 90 | FAT1, ATCC20336 (Amino Acid Seq.) | MSGLEIAAAAILGSQLLEAKYLIADDVSLAKTVAVNALPYLWK ASRGKASYWYFFEQSVFKNPNNKALAFPRPRKNAPTPKTDAEG FQIYDDQFDLEEYTYKELYDMVLKYSYILKNEYGVTANDTIGVS CMNKPLFIVLWLALWNIGALPAFLNFNTKDKPLIHCLKIVNASQ VFVDPDCDSPIRDTEAQIREELPHVQINYIDEFALFDRLRLKSTPK HRAEDKTRRPTDTSSACALIYTSGTTGLPKAGIMSWRKAFMAS VFFFGHIMKIDSKSNVLTAMPLYHSTAAMLGLCPTLIVGGCVSVS QKFSATSFWTQARLCGATHVQYVGEVCRYLLNSKPHPDQDRHN VRIAYGNGLRPDIWSEFKRRFHIEGIGEFYAATESPIATTNLQYGE YGVGACRKYGSLISLLLSTQQKLAKMDPEDESEIYKDPKTGFCT EAAYNEPGELLMRILNPNDVQKSFQGYYGNKSATNSKILTNVFK KGDAWYRSGDLLKMDEDKLLYFVDRLGDTFRWKSENVSATEV ENELMGSKALKQSVVVGVKVPNHEGRACFAVCEAKDELSHEEI LKLIHSHVTKSLPVYAQPAFIKIGTIEASHNHKVPKNQFKNQKLP KGEDGKDLIYWLNGDKYQELTEDDWSLICTGKAKL\* |
| SEQ ID NO: 91 | PXA1, ATCC20336 (Nucleic Acid Seq.) | atggtcaacatatcgaaattgacgggaataacaagcaggacatcaggaatgtggtgctattgctacag gagtttgtcaagacctacaaagacaacaagatcaaactcaactacctgagtagacctgtcatcttgttctt gagtaccaggagcaactgccggtaaggggtgatacaccagagaagcatcgtcactaagtacaacg agtacctactcaacaagagattgagacgcccaagtcaatcagacaatcctccaatatcagaagaacg gatcccgtgagatcatatccagaagggcaacggcaaagtaacaagaatcatcatcccaaaagcaaac aacgaccagtatgccgccgacaagtatataaagattagcccgcaacgagcaaatattgcaacag caaaagggaaggctcacaaaccagattcagaaccagagaccattatctggaagatcagattccaaa gactactgccaaaacacaccagagaatcgcagtgcactattgattacagaacatggagtccagag attgccaagctagatggtcagattgtcaagaacttgattgctgcagacggtaggaagtagcccgtgact tgatttactattgagattgccaccctgcacgtacaccaacgccgctatcaaatacaggagttgagattg gcgttaggattcagaactaatcaaccagatacatccatgacatgtacaggacaaaaccatgtcgtacta caaagtgggattgaacgcgccgatatccaaaacatagaccagtacatcaccgaagatgtcaccaaa actgtatgtcgagtgacgagattcctccatgggtaagccattcattgacttgatcatacagtgatatag agacaatttgggtactggtgccattattggcattttttgccaactatttttgctaccgccatcatgttgaaaa aggcaacaccaagattcggtaagttggctgccaaaagaaccaccacttggaaggtgtttatttcaaccaac agttgaacataatgaccaacagtgaagagattgggttctacaaaggatcgaagattgagaagtccaag cttgcggagaactttgacaagttgatgggtcacgtatcgagagaaatcaatttatcgtccagctatgccg ctctagaagactacgtgcttaaatacacgtggctggcctggggttacatcttttctggtctacctgtgtttt ggatgtgcttttccctaaagaagaccccaagtagtggccattgctgatatagatgatggtttgagattg gaacatgttccaattactgtgccaactgccgagggttcttactccacaccattgatcccagacctcacttttt gacatcaagggcaagaatttgtttattgttggtccaaacggttcgggcaaaacttctgttgccagggttct tgcaggtcttgcccttgtatgccgggttagtgctgaaaccactggatttgttctttaacccacaaaaga gttatttccaccaccggaagtttgcgtgaccaagttgtttaccctaatagatccgaaaacaccaccaacga tcaaattttcccacatctttacactgtgtacacttagaccatatgttaaacggtacggattgaaccagaactt ggatttcgctaaaacattgagtggaggtgagaagcaaagattgagtttcgccagagtgttgtttaacaga ccaagtattgtcattcttgatgattcgacgtcggcgttgtccccagatatggaagagttgatgtaccaggt gttgcaagatcacaagatcaattacgtcacactttcaaatcgtccctctcagtaagttccatgataaagt atttgaaatataa |
| SEQ ID NO: 92 | PXA1, ATCC20336 (Amino Acid Seq.) | MVNISKLTGYNKQDIRNVVLLLQEFVKTYKDNKIKLNYSSRPVI LFLSTLVATAGIGVFFTLRSIVTKYNEYLLNKRLRRPSLIRQSSNIL KNGSREIFIQKGNGKVTRIIIPKANNDQYAADKYLYKDFARNEQI LQQQKGRLFNSRFLNQLTIIWKILIPKFYCQNTSLLLSQCFFLIFRT WLSLLIAKLDGQIVKNLIAADGRKFARDLIYFLLIAFPASYTNAAI KYLELRLALGFRTNLTRYIHDMYLDKTMSYYKVGLNGADIQNI DQYITEDVTKFCMSLCSLFSSMGKPFIDLIFFSVYLRDNLGTGAII GIFANYFATAIMLKKATPRFGKLAAKRTHLEGVYFNQQLNIMTN SEEIGFYKGSKIEKSKLAENFDKLMGHVSREINLSSSYAALEDYV LKYTWSAWGYIFSGLPVFLDVLFPKEDPSSGHIADIDDDDHAHG HGHTGEETSSTTENMKTFVTTNKRLLLSLADAGSRLMVSLKEVTT LTGITNRVPNMLTQLHRVHDPKFDYGDKYGLPDIHGTYQLNYD GLRLEHVPITVPTAEGSYSTPLIPDLTFDIKGKNLLFVGPNGSGKT SVARVLAGLWPLYAGLVSKPSDLFFNPQKSYFTTGSLRDQVVYP NRSENTTNDQIFHILHCVHLDHIVKRYGLNQNLDFAKTLSGGEK QRLSFARVLFNRPSIVILDDSTSALSPDMEELMYQVLQDHKINYV TLSNRPSLSKFHDKVFEI\* |
| SEQ ID NO: 93 | PXA2, ATCC20336 (Nucleic Acid Seq.) | atgacagtggagaatgcaaaactacagaagaactcgttggcggttctgctcttgaaggtgtacaaatcc aacagatcattattgttaaacacctcatcatcatattaatcattgctgccacactggcgcaacgaatacc gggcgaggcacctcctccagatcatcggcaaaagtagagaccgatgaagaacaatcggttaaaaag aaacaccccaagctctctagagagtcctccatagactaagaaaagcaatcttgccaactttctttgatag aactatagttacttttttgccaactttgttggtgtgagagcattattgacacttagagttgctaccc ttgacggtcagcttgtgggggcattggttcaagaagaataagggtgttgccaagtacttgttgtactag atgcttcttggtatccccgctgcttgacaaatgccttgttgaactgaccaaactgaactgtgagcaagag cattagaatgaacttgaataatacatcatggaggaatacttgccagataacttggacccaaactattatt cattgatccatttgactgataacaagattagagacccaaatcagagaataaccactgatactagtcgttg agcgatgccttggcaagcttgcccggtcacatattgaagccaacgttggatatcatattgtgtgcgcaac |

TABLE 40-continued

| SEQ ID NO: | Description | Sequence |
|---|---|---|
| | | agttaagcaagagcggtgttggtaatggggaaggtacgttggcattaggtatattggcacacttctcaa<br>ccatgatcatccgtttcttctcccgccatttgccaagttggcggctgagagagctaaccttgaaggtca<br>gttgcgttccgcgcattccaagattgttgccaacagtgaagaaattgctttcttgggtggtcatgaccgtg<br>agttggatacacatcgaccactgctactatactttggagagattctcgaaaggcgaatattggaagcgag<br>ccatacacgaaatcacacaaacgtttattgtgaagtacttttggggtgttgcaggtttagtgttgtgttctgc<br>accggttttcattgccaaatacttgggtgagccggaagataagaatgttgctggtaatttcatcaccaaca<br>gaagattgttgatgagtgcctcggattcctggatcgtttaatctattctagaagatacttgttgcaagttgt<br>cggtcatgctaccagagtgtctgacttcttggacacttttacatgaagtggaggagaagaagaagagaat<br>cacatcgaatgtgcagtttaacaacgacgagattactttcgatcatgttagattgatgactccaacggaa<br>gtgaccttgatcccagacttgaacttttccattaaaccaggtgaccatttgttgattgtggggcaaacgg<br>ttcaggtaagtcgtcgttgttcagaatgttgggtgggttgtggcccgttaggtttggtactattagaattcc<br>aaacacagagaacatgttctacttgccgcaaaaggcttaccttgttgaaggatcattcagagagcaaat<br>catttatccacacaacgtgactcaacagaagaagactgatcaacaattgaaagagatcttgaaggttttg<br>aaattggaagattactcagggcaattggatgaggttaagaaatggagccgaagaattgtccattggtgct<br>caacaaagattggctatggctagattgtactaccacgaacctaagtttgctgtcttggacgaatgtacttc<br>agctgtgtcaccagacatggaacaactcatgtaccaacacgcacaaggtttgggtatcacgcttttgtcc<br>gttgcccatagacctgcattgtggcacttccacaaatacttgttggaattcgacgggaagggtagttact<br>actttggtacgttggatgaaaagcacaaaatgaagttagaagaagaagaacgactcaagaaggagaa<br>tgaaaagagagtgtcgccaagaagtag |
| SEQ ID NO: 94 | PXA2, ATCC20336 (Amino Acid Seq.) | MTVENAKLQKNSLAVSLLKVYKSNRSLLLNTSYIILIIAAFTGAT<br>NTGRGTSSRSSAKVETDEEQSVKKKHPKLSRESFHRLRKAILPTF<br>FDRTIVYFFANLTLLVVRALLTLRVATLDGQLVGALVSRRIRVF<br>AKYLLYWMLLGIPAALTNALLNWTKSNLSKSIRMNLNNNIMEE<br>YLPDNLDPNYYSLIHLTDNKIRDPNQRITTDTSRLSDALASLPGHI<br>LKPTLDIILCAQQLSKSGVGNGEGTLALGILAHFSTMIIRFFSPPFA<br>KLAAERANLEGQLRSAHSKIVANSEEIAFLGGHDRELDHIDHCY<br>YTLERFSKGEYWKRAIHEITQTFIVKYFWGVAGLVLCSAPVFIAK<br>YLGEPEDKNVAGNFITNRRLLMSASDSLDRLIYSRRYLLQVVGH<br>ATRVSDFLDTLHEVEEKKKRITSNVQFNNDEITFDHVRLMTPTE<br>VTLIPDLNFSIKPGDHLLIVGPNGSGKSSLFRMLGGLWPVRFGTIR<br>IPNTENMFYLPQKAYLVEGSFREQIIYPHNVTQQKKTDQQLKEIL<br>KVLKLEDYSGQLDEVKKWSEELSIGAQQRLAMARLYYHEPKFA<br>VLDECTSAVSPDMEQLMYQHAQGLGITLLSVAHRPALWHFHKY<br>LLEFDGKGSYYFGTLDEKHKMKLEEEERLKKENEKKSVAKK* |
| SEQ ID NO: 95 | PEX11, ATCC20336 (Nucleic Acid Seq.) | atggtcgccgattctttagtctaccaccccaaccgtctccaaattagtcaagttcttggacacaaccccaaa<br>gagggaaaaggtcttcagattattgtcctacttgtccagattcttgggctactacgcctacagaaagggc<br>tactccaaggaaaccatcgcccttttcgccaacttgaaaggaaacttcacattcatcagaaaggccatg<br>agattcttgaagccaataaaatcacttgccaattggcctccaaggcatacgacaacaagttgttggaccca<br>gtcttgcagatcaccaccatcatcagaaacttggcctacgccggctacttgaccatcgacggtgtcatat<br>tcttcaagttgttgggtctcattgacgccaagaagttccctaacttggctacatacgcctccagattctggt<br>tgatcggggttgattgccggtttgatcaactccttgagaatcatctactccttgaaggactacgagcacca<br>ggagggcgacaaggagaaggagaccgacgctaaggctatccacactaagttgtacgccgctaaga<br>gaaaattggtctgggacttgttggatacttttattgctttgaactcctggacatcttgcatttcaccgaggg<br>tgacgtcgggttcgctggtactatcacctcccctcttgggattggaagacttgtggaaggccacttaa |
| SEQ ID NO: 96 | PEX11, ATCC20336 (Amino Acid Seq.) | MVADSLVYHPTVSKLVKFLDTTPKREKVFRLLSYLSRFLGYYAY<br>RKGYSKETIALFANLKGNFTFIRKAMRFLKPINHLQLASKAYDN<br>KLLDPVLQITTIIRNLAYAGYLTIDGVIFFKLLGLIDAKKFPNLAT<br>YASRFWLIGLIAGLINSLRIIYSLKDYEHQEGDKEKETDAKAIHT<br>KLYAAKRKLVWDLLDTFIALNSLDILHFTEGDVGFAGTITSLLGL<br>EDLWKAT* |
| SEQ ID NO: 97 | UGTA 1 (Amino Acid Seq.) | MFEDRLMAASGLDVPIILEDSPFFKTEMKPSTSYNITLLTIGSRGD<br>VQPYMALGKGLVKEGHNVTIATHGEFGDWIKKSGLNFKEIAGN<br>PAELMSFMVTHNTMSVGFLKDAQKKFKSWIATLLTTSWKACQ<br>GSDILIESPSAMAGIHIAEALGIPYFRAFTMPWTRTRAYPHAFFVP<br>DQKKGGSYNYLTHVLFENIFWKGISGQVNKWRVQELDLPKTNL<br>YRLQQTRVPFLYNVSLTVLPPAVDFPDWIKVTGYWFLDEGSGD<br>YKPPEELVKFMSDAAADGKKIVYIGFGSIVVKDAKSLTKAVVEA<br>VKRADVRCILNKGWSDRLDKKGKDDIEVELPPEVYNSGAIPHD<br>WLFPRVDAAVHHGGSGTTGASLRAGTPTIIKPFFGDQFFYATRV<br>EDLGAGLGLKKLTAKTLANALVTVTEDLKIIEKAKRVSEQIKHE<br>HGVLSAIEAIYSELEYSRNLILVKDIYNQNYKRHHPDFRSQSGIQS<br>PVEPSDDEDEEDEEEEDSNEDDDEDNEDYEDESSDQRSKAS |
| SEQ ID NO: 98 | UGTA 1 (Nucleic Acid Seq.) | atgtttgaagacagattgatggctgcgtctggtttggatgttcctattatcttggaagactcgccattctttta<br>agacagaaatgaagccatcaacctcttacaatatcacgttgttgactattgggtcgcgaggtgatgtgca<br>accatacatggctttaggtaaaggcttagttaaagagggccacaatgttactatcgctactcacggaga<br>gttcggagactggatcaagaagagtggattgaactttaaagaaattgctggtaatcctgccgagttgatg<br>tcgtttatgtgtacccacaacaccatgtcggttggtttcctcaaggatgcccagaagaagttcaaatcctg<br>gattgccacgttgttgactaccagttgaaggctgtgtcaaggttctgatatcttgattgaaagtccttcag<br>ccatggccggtatccacattgccgaagcctaggcattccttatttcagagcattcacgatgccatggac<br>tagaactagagcgtaccgcatgcattcttgtgcctgatcaaaagaagggtggttcatacaatttatttga<br>cacatgtcttgttttgaaaatatcttctggaaaggtatttctggacaggttaacaagtggagagtgcaagag<br>ttggatttgcccaagaccaacttgtacagattgcagcaaacgagagtgccgttcttgtacaatgtctcgct |

TABLE 40-continued

| SEQ ID NO: | Description | Sequence |
|---|---|---|
| | | cactgttttgccaccggccgttgacttccccgattggattaaagtcactggttactggttttttggatgaagg<br>ttctggtgattacaaacctcctgaagagcttgtcaagtttatgagtgatgccgctgctgatgcaaaaag<br>attgtctacattggatttggttccattgttgttaaggacgccaagtcgttgacgaaagctgttgttgaagct<br>gttaagcgtgccgacgtccgttgtatcttgaacaaaggttggtccgacaggctagacaagaagggtaa<br>ggacgatatcgaagttgagttaccgccagaagtgtacaactcgggtgctatccctcatgattggttgttc<br>ccacgtgtcgacgcagctgtacaccacggtggttctggtaccactggtgctagtttgctggtgctggtaca<br>cctactattatcaaaccattctttggagaccaattttctacgccacgcgagttgaagatttaggcgccgg<br>gttgggggttgaaaaaattgactgcaaaaacgttggcaaacgcgcttgttaccgttaccgaagacttgaa<br>gattattgaaaaggcaaagagagtcagccgagcaaatcaaacacgagcatggtgttctcagtgccatcg<br>aagctatctactcagagttagagtactccaggaacttgatcttggtgaaggatatctacaaccagaacta<br>caagcgtcaccacccagatttcagatcacaatctggtattcaatcgccagttgagcctagcgatgacga<br>ggacgaagaagacgaagaagaagaagacagcaatgaagacgacgatgaggacaatgaagattatg<br>aagacgagtcatcagaccagcggtcaaaggcttcatag |
| SEQ ID NO: 99 | IDP2, S. c (Nucleic Acid Seq.) | atgacaaagattaaggtagctaaccccattgtggaaatggacggcgatgagcaaacaagaataatctg<br>gcatttaatcagggacaagttagtcttgccctatcttgacgttgatttgaagtactacgatattccgtgga<br>gtatcgtgaccagactaatgatcaagtaactgtggattctgccaccgcgactttaaagtatggagtagct<br>gtcaaatgcgcgactattacacccgatgaggcaaggagtgcgaggaatttcatttgaaaaagatgtgaa<br>atctccaaatggtactattagaaacattttgggtggtacagtgttcagagaacctattattatccctagaatt<br>ccaaggctagttcctcaatgggagaagcccatcatcattgggagcacgcattcggcgatcagtacaa<br>agctaccgatgtaatagtccctgaagaaggcgagttgaggcttgtttataaatccaagagcggaactca<br>tgatgtagatctgaaggtatttgactacccagaacatggtggggttgccatgatgatgtacaacactaca<br>gattcgatcgaagggtttgcgaaggcctcctttgaattggccattgaaaggaagttaccattatattccac<br>tactaagaatactattttgaagaagtatgatggtaaattcaaagatgttttcgaagccatgtatgctagaag<br>ttataaagagaagtttgaatcccttggcatctggtacgagcaccgttttaattgatgatatggtggcccaaa<br>tgttgaaatctaaaggtggatacataattgccatgaaaaattacgacggtgacgtagaatcagatattgtt<br>gcacaaggatttggctcctggggttaatgacatctgtgttgattaccccgacggtaaaaccttgaaa<br>gcgaagccgccacggtacagtaacaagacattttagacagcatcagcaaggaaaggagacgtcaa<br>caaattccattgcatcaattttcgcgtggactagaggtattattcaaaggggtaaacttgataatactccag<br>atgtagttaagttcggccaaatattggaaagcgctacggtaaatacagtgcaagaagatggaatcatga<br>ctaaagatttggcgctcattctcggtaagtctgaaagatccgcttatgtcactaccgaggagttcattgac<br>gcggtggaatctagattgaaaagagttcgaggcagctgcattgtaa |
| SEQ ID NO: 100 | IDP2, S. c (Amino Acid Seq.) | MTKIKVANPIVEMDGDEQTRIIWHLIRDKLVLPYLDVDLKYYDL<br>SVEYRDQTNDQVTVDSATATLKYGVAVKCATITPDEARVEEFH<br>LKKMWKSPNGTIRNILGGTVFREPIIIPRIPRLVPQWEKPIIIGRHA<br>FGDQYKATDVIVPEEGELRLVYKSKSGTHDVDLKVFDYPEHGG<br>VAMMMYNTTDSIEGFAKASFELAIERKLPLYSTTKNTILKKYDG<br>KFKDVFEAMYARSYKEKFESLGIWYEHRLIDDMVAQMLKSKG<br>GYIIAMKNYDGDVESDIVAQGFGSLGLMTSVLITPDGKTFESEA<br>AHGTVTRHFRQHQQGKETSTNSIASIFAWTRGIIQRGKLDNTPDV<br>VKFGQILESATVNTVQEDGIMTKDLALILGKSERSAYVTTEEFID<br>AVESRLKKEFEAAAL |
| SEQ ID NO: 101 | MAE1 (non-mitochondrial), Sc (Amino Acid Seq.) | MWPIQQSRLYSSNTRSHKATTTRENTFQKPYSDEEVTKTPVGSR<br>ARKIFEAPHPHATRLTVEGAIECPLESFQLLNSPLFNKGSAFTQEE<br>REAFNLEALLPPQVNTLDEQLERSYKQLCYLKTPLAKNDFMTSL<br>RVQNKVLYFALIRRHIKELVPIIYTPTEGDAIAAYSHRFRKPEGVF<br>LDITEPDSIECRLATYGGDKDVDYIVVSDSEGILGIGDQGIGGVRI<br>AISKLALMTLCGGIHPGRVLPVCLDVGTNNKKLARDELYMGNK<br>FSRIRGKQYDDFLEKFIKAVKKVYPSAVLHFEDPFGVKNARRLLE<br>KYRYELPSFNDDIQGTGAVVMASLIAALKHTNRDLKDTRVLIYG<br>AGSAGLGIADQIVNHMVTHGVDKEEARKKIFLMDRRGLILQSYE<br>ANSTPAQHVYAKSDAEWAGINTRSLHDVVENVKPTCLVGCSTQ<br>AGAFTQDVVEEMHKHNPRPIIFPLSNPTRLHEAVPADLMKWTN<br>NNALVATGSPFPPVDGYRISENNNCYSFPGIGLGAVLSRATTITD<br>KMISAAVDQLAELSPLREGDSRPGLLPGLDTITNTSARLATAVIL<br>QALEEGTARIEQEQVPGGAPGETVKVPRDFDECLQWVKAQMW<br>EPVYRPMIKVQHDPSVHTNQL |
| SEQ ID NO: 102 | MAE1 (non-mitochondrial), Sc (Nucleic Acid Seq.) | ATGTGGCCTATTCAGCAATCGCGTTTATATTCTTCTAACACTA<br>GATCGCATAAAGCTACCACAACAAGAGAAATACTTTCCAAA<br>AGCCATACAGCGACGAGGAGGTCACTAAAACACCCGTCGGTT<br>CTCGCGCCAGAAAGATCTTCGAAGCTCCTCACCCACATGCCA<br>CTCGTTTGACTGTAGAAGGTGCCATAGAATGTCCCTTGGAGA<br>GCTTTCAACTTTTAAACTCTCCTTTATTTAACAAGGGTTCTGC<br>ATTTACACAAGAAGAAAGGGAAGCGTTTAATTTAGAAGCATT<br>GCTACCACCACAAGTGAACACTTTGGACGAACAACTGGAAAG<br>AAGCTACAAGCAGTTATGCTATTTGAAGACGCCCTTGGCCAA<br>AAACGACTTCATGACGTCTTTGAGAGTACAGAACAAAGTCCT<br>ATATTTTGCATTAATAAGGAGACATATCAAGGAATTAGTTCC<br>TATCATTTACACCCCAACCGAAGGTGATGCTATTGCTGCCTAT<br>TCCCACAGGTTCAGAAAGCCAGAAGGTGTGTTTTTAGACATT<br>ACCGAACCTGATTCCATCGAATGTAGATTGGCTACATACGGT<br>GGAGACAAAGATGTAGACTACATCGTTGTGTCGGATTCGGAA<br>GGTATTCTGGGAATTGGTGACCAAGGTATCGGTGGTGTACGT<br>ATTGCTATCTCCAAATTGGCATTGATGACGCTGTGCGGTGGTA |

TABLE 40-continued

| SEQ ID NO: | Description | Sequence |
|---|---|---|
| | | TTCATCCCGGCCGTGTGCTACCTGTGTGTTTGGACGTCGGTAC<br>TAACAACAAGAAACTAGCCCGTGACGAATTGTACATGGGTAA<br>CAAGTTCTCCAGAATCAGGGGTAAGCAATATGACGACTTCTT<br>GGAAAAATTCATCAAGGCCGTTAAGAAAGTGTATCCAAGCGC<br>CGTTCTGCATTTCGAAGATTTCGGTGTTAAGAACGCTAGAAG<br>ATTACTAGAAAAGTACAGGTACGAATTGCCATCATTCAACGA<br>TGACATTCAGGGCACCGGTGCCGTCGTGATGGCCTCGTTGAT<br>TGCTGCTTTGAAACATACCAACAGAGACTTGAAAGACACCAG<br>AGTGCTTATTTACGGTGCCGGGTCTGCGGGCCTCGGTATCGC<br>AGATCAAATTGTGAATCATATGGTCACGCACGGCGTTGACAA<br>GGAAGAAGCGCGCAAGAAAATCTTCTTGATGGACAGACGTG<br>GGTTAATTCTACAATCTTACGAGGCTAACTCCACTCCCGCCCA<br>ACACGTATACGCTAAGAGTGATGCGGAATGGGCTGGTATCAA<br>CACCCGCTCTTTACATGATGTGGTGGAGAACGTCAAACCAAC<br>GTGTTTGGTTGGCTGCTCCACACAAGCAGGCGCATTCACTCA<br>AGATGTCGTAGAAGAAATGCACAAGCACAATCCTAGACCGAT<br>CATTTTCCCATTATCCAACCCTACTAGACTACACGAAGCCGTT<br>CCTGCCGATTTAATGAAGTGGACCAACAACAACGCTCTTGTA<br>GCTACCGGATCTCCTTTCCCACCTGTTGATGGTTACCGTATCT<br>CGGAGAACAACAATTGTTACTCTTTCCCAGGTATCGGTTTAG<br>GTGCCGTACTATCGCGTGCCACCACCATCACAGACAAGATGA<br>TCTCCGCTGCAGTGGACCAACTAGCCGAATTGTCGCCACTAA<br>GAGAGGGCGACTCGAGACCTGGGTTGCTACCCGGCCTGGACA<br>CCATCACCAACACTTCTGCGCGTCTAGCTACCGCTGTGATCTT<br>GCAAGCACTCGAGGAGGGAACCGCCCGTATCGAGCAAGAAC<br>AAGTACCGGGAGGAGCTCCCGGCGAAACTGTCAAGGTTCCTC<br>GTGACTTTGACGAATGTTTACAGTGGGTCAAAGCCCAAATGT<br>GGGGAGCCTGTGTACAGACCTATGATCAAGGTCCAACATGACC<br>CATCGGTGCACACCAACCAATTGTAG |
| SEQ ID NO: 103 | MAE1, Candida (Amino Acid Seq.) | MLKFNKISARFVSSTATASATSGEMRTVKTPVGIKAAIESLKPKA<br>TRVSMDGPVECPLTDFALLNSPQFNKGSAFSLEERKSFKLTGLLP<br>SQVNTLDEQVERAYRQFTYLKTPLAKNDFCTSMRLQNKVLYYE<br>LVRRNIREMLPIIYTPTEGDAIASYSDRFRKPEGCFLDINDPDNID<br>ERLAAYGENKDIDYIVMSDGEGIXXXSDRFRKPEGCFLDINDPD<br>NIDERLAAYGENKDIDYIVMSDGEGILGIDQGVGGIRIAIAKLG<br>LMTLCGGIHPARVLPITLDVGTNNDRLLNDDLYMGNKFPRVRG<br>ERYWDFVDKVIHAITKRFPSAVMHYEDFGVTTGRDMLHKYRTA<br>LPSFNDDIQGTGAVVMASITAALKFSNRSLKDIEVLIYGAGSAGL<br>GIADQITNHLVSHGATPEQARSRIHCMDRYGLITTESNNASPAQ<br>MNYADKASDWEGVDTSSLLACVEKVKPTVLVGCSTQAGAFTE<br>EVVKTMYKYNPQPIIFPLSNPTRLHEAVPADLMKWTDNNALIAT<br>GSPFEPVDGYYISENNNCFTFPGIGLGAVLSRCSTISDTMISAAVD<br>RLASMSPKMENPKNGLLPRLEEIDEVSAHVATAVILQSLKEGTA<br>RVESEKKPDGGYVEVPRDYDDCLKWVQSQMWKPVYRPYIKVE<br>YVSNIHTYQY |
| SEQ ID NO: 104 | MAE1, Candida (Nucleic Acid Seq.) | atgctcaaattcaataaaatactggccagattcgtctcctccacggccaccgcatccgccacgtcaggg<br>gaaatgcgtaccgtcaagacccagtggggatcaaggcggccatcgaatcattaaaaccaaaagcta<br>ctagagtctccatggacggacctgtcgaatgcccattgaccgatttcgccttgttgaactcccctcaattc<br>aacaaaggttcggcattttctttggaagaaaggaaaagtttcaagttgaccgggctcctccctctcaagt<br>caacactttggatgaacaggttgaaagagcctatagacaattcacatacttgaagaccccattggccaa<br>gaacgatttctgcacgtctatgagattgcagaacaaagtgcttactacgagttggttagaagaaatatcc<br>gtgagatgttgcccatcatctacacccccaaccgaaggggacgccatcgccagttattccgacaggttc<br>agaaaaccagagggctgttcttggatatcaacgaccccgacaacatcgatgagagattagctgcctat<br>ggggagaacaaagacatagattacattgtcatgagtgacggagaaggtatcnnnnnnnnctccgac<br>aggttcagaaaaccagagggctgcttcttggacatcaatgacccagacaacatcgacgagagattgg<br>ctgcctatggggagaacaaagacatagattacattgtcatgagtgacggagaaggtatcctcggtattg<br>gagaccaaggcgtcggtggtatcagaattgccattgctaaattgggggttgatgaccctttgtggtggtat<br>tcacccggccagagttttgcccatcacttttggatgttggtacaaataacgacaggttgttgaatgatgattt<br>gtacatgggcaacaagttccctagagtcagaggagaaagatactgggactttgtcgataaggtcatac<br>acgcaattacgaaacggttcccaagtgccgtgatgcattacgaagatttcggagtcacaactggtagg<br>gacatgttgcacaagtaccgtacggctcttccttctttcaacgacgacatccaaggtaccggtgcagttg<br>tcatggcatcgatcacagctgccttgaagttctccaaccgtagcctaaaggacatcgaggttttgatttac<br>ggtgccggctcagctggtttaggtattgctgaccagatcaccaaccacttggtcagccacggcgctact<br>ccagaacaagccagatcaggatccattgtatggaccgttatgggttgatcacaactgaatccaacaac<br>gccagtcctgctcaaatgaactacgccgacaaggcatctgattgggaaggtgtcgataccctcgagtct<br>acttgctgtgttgagaaagtcaaaccaactgtcttggttgggtgttccactcaggcaggtgcattcacc<br>gaagaggttgtcaaaaccatgtacaagtacaacccacagccaattattttcccattgtccaaccctacca<br>gattgcatgaagccgtgccggctgatttgatgaaatggaccgacaacaacgcgttgattgccaccggtt<br>ctccatttgaacctgtcgatggctactactactttccgaaaacaacaactgtttcaccttcccaggtattgggt<br>tgggtgctcttgtccagatgtagcaccattctgattaccattcttctgccgccgttgatagattggctt<br>cgatgtcgccaaagatggagaacccaaagaacggattgttgcctagattggaagaaatcgacgaagt<br>cagtgcccatgttgccacggctgttatcttgcaatctttgaaggaaggcaccgctagagtcgaaagcga<br>gaagaagccagacggtggttacgttgaagttccaagagactatgatgattgtcttaagtgggtgcaatc<br>acaaatgtggaagccagtgtacagaccatacatcaaggttgagtacgatcgaatattcacacctatcaa<br>tat |

TABLE 40-continued

| SEQ ID NO: | Description | Sequence |
|---|---|---|
| SEQ ID NO: 105 | MAE1, Sc (Amino Acid Seq.) | MLRTRLSVSVAARSQLTRSLTASRTAPLRRWPIQQSRLYSSNTRS HKATTTRENTFQKPYSDEEVTKTPVGSRARKIFEAPHPHATRLT VEGAIECPLESFQLLNSPLFNKGSAFTQEEREAFNLEALLPPQVN TLDEQLERSYKQLCYLKTPLAKNDFMTSLRVQNKVLYFALIRRH IKELVPIIYTPTEGDAIAAYSHRFRKPEGVFLDITEPDSIECRLATY GGDKDVDYIVVSDSEGILGIGDQGIGGVRIAISKLALMTLCGGIH PGRVLPVCLDVGTNNKKLARDELYMGNKFSRIRGKQYDDFLEK FIKAVKKVYPSAVLHFEDFGVKNARRLLEKYRYELPSFNDDIQG TGAVVMASLIAALKHTNRDLKDTRVLIYGAGSAGLGIADQIVNH MVTHGVDKEEARKKIFLMDRRGLILQSYEANSTPAQHVYAKSD AEWAGINTRSLHDVVENVKPTCLVGCSTQAGAFTQDVVEEMH KHNPRPIIFPLSNPTRLHEAVPADLMKWTNNNALVATGSPFPPV DGYRISENNNCYSFPGIGLGAVLSRATTITDKMISAAVDQLAELS PLREGDSRPGLLPGLDTITNTSARLATAVILQALEEGTARIEQEQ VPGGAPGETVKVPRDFDECLQWVKAQMWEPVYRPMIKVQHDP SVHTNQL |
| SEQ ID NO: 106 | MAE1, Sc (Nucleic Acid Seq.) | ATGCTTAGAACCAGACTATCCGTTTCCGTTGCTGCTAGATCGC AACTAACCAGATCCTTGACAGCATCAAGGACAGCACCATTAA GAAGATGGCCTATTCAGCAATCGCGTTTATATTCTTCTAACAC TAGATCGCATAAAGCTACCACAACAAGAGAAAATACTTTCCA AAAGCCATACAGCGACGAGGAGGTCACTAAAACACCCGTCG GTTCTCGCGCCAGAAAGATCTTCGAAGCTCCTCACCCACATG CCACTCGTTTGACTGTAGAAGGTGCCATAGAATGTCCCTTGG AGAGCTTTCAACTTTTAAACTCTCCTTTATTTAACAAGGGTTC TGCATTTACACAAGAAGAAAGGGAAGCGTTTAATTTAGAAGC ATTGCTACCACCACAAGTGAACACTTTGGACGAACAACTGGA AAGAAGCTACAAGCAGTTATGCTATTTGAAGACGCCCTTGGC CAAAAACGACTTCATGACGTCTTTGAGAGTACAGAACAAAGT CCTATATTTTGCATTAATAAGGAGACATATCAAGGAATTAGT TCCTATCATTTACACCCCAACCGAAGGTGATGCTATTGCTGCC TATTCCCACAGGTTCAGAAAGCCAGAAGGTGTGTTTTTAGAC ATTACCGAACCTGATTCCATCGAATGTAGATTGGCTACATAC GGTGGAGACAAAGATGTAGACTACATCGTTGTGTCGGATTCG GAAGGTATTCTGGGAATTGGTGACCAAGGTATCGGTGGTGTA CGTATTGCTATCTCCAAATTGGCATTGATGACGCTGTGCGGTG GTATTCATCCCGGCCGTGTGCTACCTGTGTGTTTGGACGTCGG TACTAACAACAAGAAACTAGCCCGTGACGAATTGTACATGGG TAACAAGTTCTCCAGAATCAGGGGTAAGCAATATGACGACTT CTTGGAAAAATTCATCAAGGCCGTTAAGAAAGTGTATCCAAG CGCCGTTCTGCATTTCGAAGATTTCGGTGTTAAGAACGCTAG AAGATTACTAGAAAAGTACAGGTACGAATTGCCATCATTCAA CGATGACATTCAGGGCACCGGTGCCGTCGTGATGGCCTCGTT GATTGCTGCTTTGAAACATACCAACAGAGACTTGAAAGACAC CAGAGTGCTTATTTACGGTGCCGGGTCTGCGGGCCTCGGTAT CGCAGATCAAATTGTGAATCATATGGTCACGCACGGCGTTGA CAAGGAAGAAGCGCGCAAGAAAATCTTCTTGATGGACAGAC GTGGGTTAATTCTACAATCTTACGAGGCTAACTCCACTCCCGC CCAACACGTATACGCTAAGAGTGATGCGGAATGGGCTGGTAT CAACACCCGCTCTTTACATGATGTGGTGGAGAACGTCAAACC AACGTGTTTGGTTGGCTGCTCCACACAAGCAGGCGCATTCAC TCAAGATGTCGTAGAAGAAATGCACAAGCACAATCCTAGACC GATCATTTTCCCATTATCCAACCCTACTAGACTACACGAAGCC GTTCCTGCCGATTTAATGAAGTGGACCAACAACAACGCTCTT GTAGCTACCGGATCTCCTTTCCCACCTGTTGATGGTTACCGTA TCTCGGAGAACAACAATTGTTACTCTTTCCCAGGTATCGGTTT AGGTGCCGTACTATCGCGTGCCACCACCATCACAGACAAGAT GATCTCCGCTGCAGTGGACCAACTAGCCGAATTGTCGCCACT AAGAGAGGGCGACTCGAGACCTGGGTTGCTACCCGGCCTGGA CACCATCACCAACACTTCTGCGCGTCTAGCTACCGCTGTGATC TTGCAAGCACTCGAGGAGGGAACCGCCCGTATCGAGCAAGA ACAAGTACCGGGAGGAGCTCCCGGCGAAACTGTCAAGGTTCC TCGTGACTTTGACGAATGTTTACAGTGGGTCAAAGCCCAAAT GTGGGAGCCTGTGTACAGACCTATGATCAAGGTCCAACATGA CCCATCGGTGCACACCAACCAATTGTAG |
| SEQ ID NO: 107 | PYC2, Sc (Amino Acid Seq.) | MSSSKKLAGLRDNFSLLGEKNKILVANRGEIPIRIFRSAHELSMR TIAIYSHEDRLSMHRLKADEAYVIGEEGQYTPVGAYLAMDEIIEI AKKHKVDFIHPGYGFLSENSEFADKVVKAGITWIGPPAEVIDSV GDKVSARHLAARANVPTVPGTPGPIETVQEALDFVNEYGYPVII KAAFGGGGRGMRVVREGDDVADAFQRATSEARTAFGNGTCFV ERFLDKPKHIEVQLLADNHGNVVHLFERDCSVQRRHQKVVEVA PAKTLPREVRDAILTDAVKLAKVCGYRNAGTAEFLVDNQNRHY FIEINPRIQVEHTITEEITGIDIVSAQIQIAAGATLTQLGLLQDKITT RGFSIQCRITTEDPSKNFQPDTGRLEVYRSAGGNGVRLDGGNAY AGATISPHYDSMLVKCSCSGSTYEIVRRKMIRALIEFRIRGVKTNI |

TABLE 40-continued

| SEQ ID NO: | Description | Sequence |
|---|---|---|
| | | PFLLTLLTNPVFIEGTYWTTFIDDTPQLFQMVSSQNRAQKLLHYL<br>ADLAVNGSSIKGQIGLPKLKSNPSVPHLHDAQGNVINVTKSAPPS<br>GWRQVLLEKGPSEFAKQVRQFNGTLLMDTTWRDAHQSLLATR<br>VRTHDLATIAPTTAHALAGAFALECWGGATFDVAMRFLHEDPW<br>ERLRKLRSLVPNIPFQMLLRGANGVAYSSLPDNAIDHFVKQAKD<br>NGVDIFRVFDALNDLEQLKVGVNAVKKAGGVVEATVCYSGDM<br>LQPGKKYNLDYYLEVVEKIVQMGTHILGIKDMAGTMKPAAAKL<br>LIGSLRTRYPDLPIHVHSHDSAGTAVASMTACALAGADVVDVAI<br>NSMSGLTSQPSINALLASLEGNIDTGINVEHVRELDAYWAEMRL<br>LYSCFEADLKGPDPEVYQHEIPGGQLTNLLFQAQQLGLGEQWA<br>ETKRAYREANYLLGDIVKVTPTSKVVGDLAQFMVSNKLTSDDIR<br>RLANSLDFPDSVMDFFEGLIGQPYGGFPEPLRSDVLRNKRRKLT<br>CRPGLELEPFDLEKIREDLQNRFGDIDECDVASYNMYPRVYEDF<br>QKIRETYGDLSVLPTKNFLAPAEPDEEIEVTIEQGKTLIIKLQAVG<br>DLNKKTGQREVYFELNGELRKIRVADKSQNIQSVAKPKADVHD<br>THQIGAPMAGVIIEVKVHKGSLVKKGESIAVLSAMKMEMVVSSP<br>ADGQVKDVFIKDGESVDASDLLVVLEEETLPPSQKK* |
| SEQ ID NO: 108 | PYC2, Sc (Nucleic Acid Seq.) | ATGAGCAGTAGCAAGAAATTGGCCGGTCTTAGGGACAATTTC<br>AGTTTGCTCGGCGAAAAGAATAAGATCTTGGTCGCCAATAGA<br>GGTGAAATTCCGATTAGAATTTTTAGATCTGCTCATGAGCTGT<br>CTATGAGAACCATCGCCATATACTCCCATGAGGACCGTCTTTC<br>AATGCACAGGTTGAAGGCGGACGAAGCGTATGTTATCGGGG<br>AGGAGGGCCAGTATACACCTGTGGGTGCTTACTTGGCAATGG<br>ACGAGATCATCGAAATTGCAAAGAAGCATAAGGTGGATTTCA<br>TCCATCCAGGTTATGGGTTCTTGTCTGAAAATTCGGAATTTGC<br>CGACAAAGTAGTGAAGGCCGGTATCACTTGGATCGGCCCTCC<br>AGCTGAAGTTATTGACTCTGTGGGTGACAAAGTCTCTGCCAG<br>ACACTTGGCAGCAAGAGCTAACGTTCCTACCGTTCCCGGTAC<br>TCCAGGACCTATCGAAACTGTGCAAGAGGCACTTGACTTCGT<br>TAATGAATACGGCTACCCGGTGATCATTAAGGCCGCCTTTGG<br>TGGTGGTGGTAGAGGTATGAGAGTCGTTAGAGAAGGTGACG<br>ACGTGGCAGATGCCTTTCAACGTGCTACCTCCGAAGCCCGTA<br>CTGCCTTCGGTAATGGTACCTGCTTTGTGGAAAGATTCTTGGA<br>CAAGCCAAAGCATATTGAAGTTCAATTGTTGGCTGATAACCA<br>CGGAAACGTGGTTCATCTTTTCGAAAGAGACTGTTCTGTGCA<br>AAGAAGACACCAAAAAGTTGTCGAAGTCGCTCCAGCAAAGA<br>CTTTGCCCCGTGAAGTTCGTGACGCTATTTTGACAGATGCTGT<br>TAAATTAGCTAAGGTATGTGGTTACAGAAACGCAGGTACCGC<br>CGAATTCTTGGTTGACAACCAAAACAGACACTATTTCATTGA<br>AATTAATCCAAGAATTCAAGTGGAGCATACCATCACTGAAGA<br>AATCACCGGTATTGACATTGTTTCTGCCCAAATCCAGATTGCC<br>GCAGGTGCCACTTTGACTCAACTAGGTCTATTACAGGATAAA<br>ATCACCACCCGTGGGTTTTCCATCCAATGTCGTATTACCACTG<br>AAGATCCCTCTAAGAATTTCCAACCGGATACCGGTCGCCTGG<br>AGGTCTATCGTTCTGCCGGTGGTAATGGTGTGAGATTGGACG<br>GTGGTAACGCTTATGCAGGTGCTACTATCTCGCCTCACTACGA<br>CTCAATGCTGGTCAAATGTTCATGCTCTGGTTCTACTTATGAA<br>ATCGTCCGTAGGAAGATGATTCGTGCCCTGATCGAATTCAGA<br>ATCAGAGGTGTTAAGACCAACATTCCCTTCCTATTGACTCTTT<br>TGACCAATCCAGTTTTTATTGAGGGTACATACTGGACGACTTT<br>TATTGACGACACCCCACAACTGTTCCAAATGGTATCGTCACA<br>AAACAGAGCGCAAAAACTGTTACACTATTTGGCAGACTTGGC<br>AGTTAACGGTTCTTCTATTAAGGGTCAAATTGGCTTGCCAAA<br>ACTAAAATCAAATCCAAGTGTCCCCCATTTGCACGATGCTCA<br>GGGCAATGTCATCAACGTTACAAAGTCTGCACCACCATCCGG<br>ATGGAGACAAGTGCTACTGGAAAAGGGACCATCTGAATTTGC<br>CAAGCAAGTCAGACAGTTCAATGGTACTCTACTGATGGACAC<br>CACCTGGAGAGACGCTCATCAATCTCTACTTGCAACAAGAGT<br>CAGAACCCACGATTTGGCTACAATCGCTCCAACAACCGCACA<br>TGCCCTTGCAGGTGCTTTCGCTTTAGAATGTTGGGGTGGTGCT<br>ACATTCGACGTTGCAATGAGATTCTTGCATGAGGATCCATGG<br>GAACGTCTGAGAAAATTAAGATCTCTGGTGCCTAATATTCCA<br>TTCCAAATGTTATTACGTGGTGCCAACGGTGTGGCTTACTCTT<br>CATTACCTGACAATGCTATTGACCATTTTGTCAAGCAAGCCA<br>AGGATAATGGTGTTGATATATTTAGAGTTTTTGATGCCTTGAA<br>TGATTTAGAACAATTAAAAGTTGGTGTGAATGCTGTCAAGAA<br>GGCCGGTGGTGTTGTCGAAGCTACTGTTTGTTACTCTGGTGAC<br>ATGCTTCAGCCAGGTAAGAAATACAACTTAGACTACTACCTA<br>GAAGTTGTTGAAAAAATAGTTCAAATGGGTACACATATCTTG<br>GGTATTAAGGATATGGCAGGTACTATGAAACCGGCCGCTGCC<br>AAATTATTAATTGGCTCCCTAAGAACAGATATCCGGATTTA<br>CCAATTCATGTTCACAGTCATGACTCCGCAGGTACTGCTGTTG<br>CGTCTATGACTGCATGTGCCCTAGCAGGTGCTGATGTTGTCGA<br>TGTAGCTATCAATTCAATGTCGGGCTTAACTTCCCAACCATCA<br>ATTAATGCACTGTTGGCTTCATTAGAAGGTAACATTGATACTG<br>GGATTAACGTTGAGCATGTTCGTGAATTAGATGCATACTGGG |

TABLE 40-continued

| SEQ ID NO: | Description | Sequence |
|---|---|---|
| | | CCGAAATGAGACTGTTGTATTCTTGTTTCGAGGCCGACTTGAA<br>GGGACCAGATCCAGAAGTTTACCAACATGAAATCCCAGGTGG<br>TCAATTGACTAACTTGTTATTCCAAGCTCAACAACTGGGTCTT<br>GGTGAACAATGGGCTGAAACTAAAAGAGCTTACAGAGAAGC<br>CAATTACCTACTGGGAGATATTGTTAAAGTTACCCCAACTTCT<br>AAGGTTGTCGGTGATTTAGCTCAATTCATGGTTTCTAACAAAC<br>TGACTTCCGACGATATTAGACGTTTAGCTAATTCTTTGGACTT<br>TCCTGACTCTGTTATGGACTTTTTTGAAGGTTTAATTGGTCAA<br>CCATACGGTGGGTTCCCAGAACCATTAAGATCTGATGTATTG<br>AGAAACAAGAGAAGAAAGTTGACGTGCCGTCCAGGTTTAGA<br>ATTAGAACCATTTGATCTCGAAAAAATTAGAGAAGACTTGCA<br>GAACAGATTCGGTGATATTGATGAATGCGATGTTGCTTCTTAC<br>AATATGTATCCAAGGGTCTATGAAGATTTCCAAAAGATCAGA<br>GAAACATACGGTGATTTATCAGTTCTACCAACCAAAAATTTC<br>CTAGCACCAGCAGAACCTGATGAAGAAATCGAAGTCACCATC<br>GAACAAGGTAAGACTTTGATTATCAAATTGCAAGCTGTTGGT<br>GACTTAAATAAGAAAACTGGGCAAAGAGAAGTGTATTTTGAA<br>TTGAACGGTGAATTAAGAAAGATCAGAGTTGCAGACAAGTCA<br>CAAAACATACAATCTGTTGCTAAACCAAAGGCTGATGTCCAC<br>GATACTCACCAAATCGGTGCACCAATGGCTGGTGTTATCATA<br>GAAGTTAAAGTACATAAAGGGTCTTTGGTGAAAAAGGGCGA<br>ATCGATTGCTGTTTTGAGTGCCATGAAAATGGAAATGGTTGT<br>CTCTTCACCAGCAGATGGTCAAGTTAAAGACGTTTTCATTAA<br>GGATGGTGAAAGTGTTGACGCATCAGATTTGTTGGTTGTCCT<br>AGAAGAAGAAACCCTACCCCCATCCCAAAAAAGTAA |
| SEQ ID NO: 109 | GUT2, Candida (Amino Acid Seq.) | MSRFLKSTFAKSALAAGAAVGGTIVYLDFIKPKNETHLATTYPA<br>FNKNIPAPPPRESLIENLKKTPQFDVLVIGGGAVGTGTALDAATR<br>GLNVCLLEKTDFGAGTSSKSTKMAHGGVRYLEKAIFQLSRAQL<br>DLVIEALNERGNMLRTAPHLCSVLPIMIPVYNWWQVPYFFAGC<br>KMYDWFAGKQNLRSSTIFTTEQAAAIAPMMDTSNLKAACVYH<br>DGSFNDTRYNVSLAVTAIKNGATVLNYFEVEQLLKDDKGKLYG<br>VKAKDLETNETYEIKATSVVNATGPFADKILEMDEDPKGLPPKV<br>EQPPRMVVPSSGVHIVLPEYYCPTNYGLLDPSTSDGRVMFFLPW<br>QGKVLAGTTDTPLKTVPANPVPTEEEIQDIIKEMQKYLVFPIDRN<br>DVLSAWSGIRPLVRDPSTIPKGQEGSGKTEGLVRSHLLVQSPTGL<br>VTISGGKWTTYREMAQETVDYLVDHPSYGDKKLLPCQTNKLLL<br>VGGENYTKNYSARLIHEYKIPLKLAKHLSHNYGSRAPLVLDLYA<br>ESDFNKLPVTLAATKEFEPSEKKANEDNQLSYQSFDEPPFTVAEL<br>KYSLKYEYPRTPLDFLARRTRLAFLNAREALNAVDGVVEIMSQE<br>YGWDKETEDRLRKEARQYIGNMGISPKKFDVEKIVIQ |
| SEQ ID NO: 110 | GUT2, Candida (Nucleic Acid Seq.) | atgtcaagattcaaaagtcaaccatgcaaagtcagccttagctgctggtgctgcagtcggtggtaccat<br>cgtgtacaggatacatcaagccaaagaacgaaacccacaggccactacctacccagccacaacaa<br>gaacataccagctcctccccacgtgagtccttgatcgaaaacttgaagaagactcctcaattcgacgt<br>caggtcattggtggtggtgcagaggtaccggtactgctctcgacgctgccacgcgtgggaaaatgtg<br>tgtcattggaaaaaaccgacacggtgcaggaacacggtcgaagtccaccaaaatggcccacggtggt<br>gtccgttacaggagaaggccattatcaattgtccagagcccaaaggacaggtcattgaagccagaa<br>cgaaagaggtaacatgttgagaactgctcctcacagtgctctgattgccaatcatgattccagtctacaa<br>ctggtggcaggaccaactattcgctggagtaagatgtacgattggatgccggtaagcaaaacagcg<br>acctccactatcacaccactgaacaggctgccgcatctgcccccaatgatggatacactaacttgaaag<br>ccgcctgtgtctaccacgatggtagatcaacgataccagatacaacgtctccaggctgtcaccgccat<br>caagaacggcgccactgtcagaactatacgaagagagcaattgagaaagatgacaagggtaaga<br>gtacggtgtcaaggccaaggataggaaaccaacgagacctacgagatcaaagccactagtgagtca<br>acgctaccggtccatcgctgataagatcaggagatggacgaagatccaaagggatgcctccaaagg<br>tcgagcaaccaccaagaattggagaccatcaccggtgtccacattgattgcctgaatactactgccca<br>accaactacggatgaagacccatccacctccgacggtagagtcatgactattgccatggcaaggtaa<br>ggtcaggctggtaccactgatactccattgaagactgacctgccaaccctgaccaactgaggaagaa<br>atccaagacatcatcaaagaaatgcaaaagtaccagattcccaatcgacgaaacgacgattgtctg<br>cttggtccggtatcagaccattggttagagacccatctactattccaaaggcgcaagaaggctctggta<br>agactgaaggatagacgacccacttgaagacaatcccaactggtaggtcaccatctccggtgta<br>aatggaccacctacagagaaatggcccaagaaactgagactacctcgagatcacatagctacggcg<br>acaagaagctcagccatgccagaccaacaaattgctcaggaggtggtgaaaactacaccaagaact<br>actctgccagattgatccacgaatacaagatccattgaagaggccaagcacagtcccacaactacg<br>gaccagagctccattggtcaggacagtacgctgaaagtgatacaacaagagccagtccaccaggct<br>gccaccaaggagatgagccatctgaaaagaaggccaacgaagacaaccagagagaaccagaga<br>tcgacgagccattcaccgttgctgagttgaagtactccttgaagtacgagtacccaagaaccccactcg<br>atttcttggccagaagaacgagattggctttcttgaacgccagaaggccctcaatgcggttgatgggg<br>ttgttgaaatcatgagtcaagagtacggccaagggagaccgaagatagattgagaaagaagc<br>cagacaatacattggtaatatgggtattctccaaagaaatttgacgttgaaaagattgttattcaa |
| SEQ ID NO: 111 | gpsA, Af (Amino Acid Seq.) | MIVSILGAGAMGSALSVPLVDNGNEVRIWGTEFDTEILKSISAGR<br>EHPRLGVKLNGVEIFWPEQLEKCLENAEVVLLGVSTDGVLPVM<br>SRILPYLKDQYIVLISKGLIDFDNSVLTVPEAVWRLKHDLRERTV<br>AITGPAIAREVAKRMPTTVVFSSPSESSANKMKEIFETEYFGVEV<br>TTDIIGTEITSALKNVYSIAIAWIRGYESRKNVEMSNAKGVIATRA<br>INEMAELIEILGGDRETAFGLSGFGDLIATFRGGRNGMLGELLGK |

TABLE 40-continued

| SEQ ID NO: | Description | Sequence |
|---|---|---|
| | | GLSIDEAMEELERRGVGVVEGYKTAEKAYRLSSKINADTKLLDS<br>IYRVLYEGLKVEEVLFELATFK |
| SEQ ID NO: 112 | gpsA, Af (Nucleic Acid Seq.) | atgattgtttcgatactgggagcgggtgcaatgggctcagccctctccgtcccgctcgtagataacggc<br>aacgaagtgagaatctggggaccgagttcgatacggagattttaaaatcaatctcagccggcagag<br>agcatccaaggcttggtgtaaagctcaatggcgtggaaattttctggccagagcagcttgaaaaatgttt<br>ggagaatgcagaggttgtacttctgggtgttagcacggatggcgtgctgcccgtaatgagcagaattct<br>cccgtatctcaaggaccagtacatcgtactcatctctaaagggctgattgattttgataacagtgttctgac<br>ggttcccgaagctgtatggaggttaaagcacgatttgagggaaaggactgtggcgataaccgggccc<br>gctattgcaagagaggtggcgaaacgcatgcccacaacctgttttcagcagccgcatccgaaagctc<br>ggccaataaaatgaaagaaatctttgagacagagtactttggcgttgaagtaacaacagacataattgg<br>cacggaaataaccctcgccctcaaaaacgtttattccatagccattgcatggataaggggctacgaga<br>gcagaaaaaacgttgagatgagcaatgcaaaggagtgattgcaacgagagccataaacgagatgg<br>cagagctgatagagattctcggaggggatagagagaccgcctttggcattccggattcttggagacctc<br>atcgcaaccttcaggggaggaaggaacgggatgctgggagagctgcttggaaaggggcttagcatc<br>gatgcaggccgatgcaggaggagcttgagaggagaggagtggtgtggttgagggctacaaaacggcaga<br>gaaaagcatacaggctgtccagcaaaataaatgcagacacaaagctgctcgacagcatctacgagtc<br>ctttatgaaggactgaaggttgaggaagtgctgtttgaactcgctacatttaaataa |
| SEQ ID NO: 113 | ADH1-2, Candida (Amino Acid Seq.) | MHALFSKSVFLKYVSSPTTSAIPHSLEFIVSRSSYLRRRIPPYLPRC<br>SHFPSFYYSSSSVYTKKSFHTMSANIPKTQKAVVFEKNGGELKY<br>KDIPVPTPKANELLINVKYSGVCHTDLHAWKGDWPLDTKLPLV<br>GGHEGAGVVVGMGENVKGWKIGDFAGIKWLNGSCMSCEFCQQ<br>GAEPNCGEADLSGYTHDGSFEQYATADAVQAARIPAGTDLAEV<br>APILCAGVTVYKALKTADLAAGQWVAISGAGGGLGSLAVQYA<br>VAMGLRVVAIDGGDEKGDFVKSLGAEAYIDFLKEKGIVAAVKK<br>ATDGGPHGAINVSVSEKAIDQSVEYVRPLGKVVLVGLPAGSKVT<br>AGVFEAVVKSIEIKGSYVGNRKDTAEAVDFFSRGLIKCPIKIVGL<br>SELPQVFKLMEEGKILGRYVLDTSK |
| SEQ ID NO: 114 | ADH1-2, Candida (Nucleic Acid Seq.) | atgtctgctaatatcccaaaaactcaaaaagctgtcgtcttcgagaagaacggtggtgaattaaaatacaa<br>agacatcccagtgccaaccccaaaggccaacgaattgctcatcaacgtcaagtactcgggtgtctgt<br>cacactgatttgcacgcctggaagggtgactggccattggacaccaaattgccattggttggtggtcac<br>gaaggtgctggtgttgttgtcggcatgggtgaaaacgtcaagggctggaaaatcggtgatttcgccgg<br>tatcaaatggttgaacggttcttgtatgtcctgtgagttctgtcagcaaggtgctgaaccaaactgtggtg<br>aagctgacttgtctggttacacccacgatggttattcgaacaatacgccactgctgatgctgtgcaagc<br>cgccagaatcccagctggcactgatttggccgaagttgccccaatcttgtgtgctggtgtcaccgtctac<br>aaagccttgaagactgccgacttggctgctggtcaatgggtcgctatctccggtgctggtggtggtttg<br>ggctccttggctgtcaatacgccgtcgccatgggtttgagagtcgttgccattgacggtggtgacgaa<br>aagggtgactttgtcaagtccttgggtgctgaagcctacattgattcctcaaggaaaagggcattgttg<br>ctgctgtcaagaaggccactgatggcggtccacacggtgctatcaatgtttccgtttccgaaaaagcca<br>ttgaccaatctgtcgagtacgttagaccattgggtaaggttgttttggttggtttgccagctggctccaag<br>gtcactgctggtgtttttcgaagccgttgtcaagtccattgaaatcaagggttcttacgtcggtaacagaaa<br>ggatactgccgaagccgttgacttttttctccagaggcttgatcaagtgtccaatcaagattgtgggcttga<br>gtgaattgccacaggtcttcaagttgatggaagaaggtaagatcttgggtagatacgtcttggataccctc<br>caaa |
| SEQ ID NO: 115 | ADH2a, Candida (Amino Acid Seq.) | MSIPTTQKAIIFETNGGKLEYKDIPVPKPKPNELLINVKYSGVCHT<br>DLHAWKGDWPLDTKLPLVGGHEGAGVVVAIGDNVKGWKVGD<br>LAGVKWLNGSCMNCEYCQQGAEPNCPQADLSGYTHDGSFQQY<br>ATADAVQAARIPAGTDLANVAPILCAGVTVYKALKTADLQPGQ<br>WVAISGAAGGLGSLAVQYAKAMGYRVVAIDGGADKGEFVKSL<br>GAEVFVDFLKEKDIVGAVKKATDGGPHGAVNVSISEKAINQSVD<br>YVRTLGKVVLVGLPAGSKVSAPVFDSVVKSIQIKGSYVGNRKDT<br>AEAVDFFSRGLIKCPIKVVGLSELPEVYKLMEEGKILGRYVLDNS<br>K |
| SEQ ID NO: 116 | ADH2a, Candida (Nucleic Acid Seq.) | atgtcaattccaactactcaaaaagctatcattttcgaaaccaacggtggaaaattagaatacaaggaca<br>tcccagttccaaagccaaagccaaacgaattgctcatcaacgtcaagtactccggtgtctgccacactg<br>atttacacgcctggaagggtgactggccattggacaccaagttgccattggtgggtggtcacgaaggt<br>gctggtgttgttgttgccattggtgacaatgtcaagggatggaaggtcggtgatttggccggtgtcaagt<br>ggttgaacggttcctgcatgaactgtgagtactgtcaacagggtgccgaaccaaactgtccacaggctg<br>acttgtctggttacacccacgacggttattccagcaatacgccactgcagatgccgtgcaagccgcta<br>gaattccagctggtactgatttagccaacgttgcccccatcttgtgtgctggtgtcactgtttacaaggcct<br>tgaagaccgccgacttgcagccaggtcaatgggtcgccattccggtgccgctggtggtttgggttcttt<br>ggccgttcaatacgccaaggccatgggctacagagttgtcgccatcgatggtggtgccgacaagggt<br>gagttcgtcaagtctttgggcgctgaggtctttgttgatttcctcaaggaaaaggacattgttggtgctgtc<br>aagaaggccaccgatggtggcccacacggtgccgttaacgtttccatctccgaaaaggccatcaacc<br>aatctgtcgactacgttagaaccttgggtaaggttgtcttggtcggttttgccagctggctccaaggtttct<br>gctccagtctttgactccgtcgtcaagtccatccaaatcaagggttcctatgtcggtaacagaaaggaca<br>ctgccgaagctgttgactttttctccagaggcttgatcaagtgtccaatcaaggttgtcggtttgagtgaat<br>tgccagaagtctacaagttgatggaagaaggtaagatcttgggtagatacgtcttggacaactctaag |
| SEQ ID NO: 117 | ADH2b, Candida (Amino Acid Seq.) | MSIPTTQKAVIYEANSAPLQYTDIPVPVPKPNELLVHVKYSGVCH<br>SDIHVWKGDWFPASKLPVVGGHEGAGVVVAIGENVQGWKVGD<br>LAGIKMLNGSCMNCEYCQQGAEPNCPHADVSGYSHDGTFQQY<br>ATADAVQAAKFPAGSDLASIAPISCAGVTVYKALKTAGLQPGQ |

TABLE 40-continued

| SEQ ID NO: | Description | Sequence |
|---|---|---|
| | | WVAISGAAGGLGSLAVQYAKAMGLRVVAIDGGDERGVFVKSL<br>GAEVFVDFTKEANVSEAIIKATDGGAHGVINVSISEKAINQSVEY<br>VRTLGTVVLVGLPAGAKLEAPIFNAVAKSIQIKGSYVGNRRDTA<br>EAVDFFARGLVKCPIKVVGLSELPEIFKLLEEGKILGRYVVDTAK |
| SEQ ID NO: 118 | ADH2b, Candida (Nucleic Acid Seq.) | atgtcaattccaactacccaaaaagctgttatctacgaagccaactctgctccattgcaatacaccgatat<br>cccagttccagtccctaagccaaacgaattgctcgtccacgtcaaatactccggtgttttgtcactcagat<br>atacacgtctggaagggtgactggttcccagcatcgaaattgcccgttgttggtggtcacgaaggtgcc<br>ggtgttgtcgttgccattggtgaaaacgtccaaggctggaaagtaggtgacttggcaggtataaagatg<br>ttgaatggttcctgtatgaactgtgaatactgtcaacaaggtgctgaaccaaactgtccccacgctgatgt<br>ctcgggttactcccacgacggtactttccaacagtacgctaccgccgatgctgttcaagctgctaaattc<br>ccagctggttctgatttagctagcatcgcacctatatcctgcgccggtgttactgtttacaaagcattgaa<br>aactgcaggcttgcagccaggtcaatgggttgccatctctggtgcagctggtggtttgggttctttggct<br>gtgcaatacgccaaggccatgggtttggacgtcgtggccattgacggtggtgacgaaagaggagtgt<br>ttgtcaaatcgttgggtgctgaagttttcgttgatttcaccaaagaggccaatgtctctgaggctatcatca<br>aggctaccgacggtggtgcccatggcgtcatcaacgtttccatttctgaaaaagccatcaaccagtctg<br>ttgaatatgttagaactttgggaactgttgtcttggttggtttgccagctggtgcaaagctcgaagctccta<br>tcttcaatgccgttgccaaatccatccaaatcaaaggttctacgtgggaaacagaagagacactgctg<br>aggctgttgatttcttcgctagagggtttggtcaaatgtccaattaaggtcgttgttgggttgagtgaattgccag<br>agattttcaaattgttggaagagggtaagatcttgggtagatacgttgttgacactgccaag |
| SEQ ID NO:119 | ADH3 (Amino Acid Seq.) | MSTQSGYGYVKGQKTIQKYTDIPIPTPGPNEVLLKVEAAGLCLS<br>DPHTLIGGPIESKPPLPNATKFIMGHEIAGSISQVGANLANDPYYK<br>KGGRFALTIAQACGICENCRDGYDAKCESTTQAYGLNEDGGFQ<br>QYLLIKNLRTMLPIPEGVSYEEAAVSTDSVLTPFHAIQKVAHLLH<br>PTTKVLVQGCGGLGFNAIQILKSYNCYIVATDVKPELEKLALEY<br>GANEYHTDLTKSKHEPMSFDLIFDLVGIQPTFDLSDRYIKARGKI<br>LMIGLGRSKLFIPNYKLGIREVEIIFNFGGTSAEQIECMKWVAKG<br>LIKPNIHVADFASLPEYLEDLAKGKLTGRIVFRPSKL |
| SEQ ID NO: 120 | ADH3 (Nucleic Acid Seq.) | Atgtcaactcaatcaggttacggatacgtgaaaggacaaaagaccattcagaaatacaccgacatcc<br>cgatccctacgccgggccccaacgaagtcttgttgaaagtcgaagctgccggcttgtgtctctcggatc<br>cacacacgttgatcgggggtcccattgagagcaagccgccgttgccgaacgccacgaagttcatcat<br>gggtcacgaaatcgcggggctgattagccaagtaggcgccaacttggcaacgatccatactataaa<br>aagggaggtaggttcgccttgactatcgcgcaggcttgtgggattgtgagaattgtcgtgatgggtatg<br>atgcaaagtgtgagtctacgacgcaggcttatgggttgaacgaggacggtggattccagcaatacttgt<br>tgattaagaacttgcgtacgatgttgcctatccctgaggtgtgagttacgaagaagccgctgtgtctac<br>tgactctgtgttgactccattccatgccgattcagaaggtcgctcatttgttgcacccaactactaaggtgtt<br>ggtcagggtgtggtgggttaggcttcaacgctattcaaatattgaagagctacaattgttacattgttgc<br>cactgatgtcaaaccagagcttgaaaaattagctttggagtatggtgccaacgaataccacactgatctc<br>accaagtccaagcatgagccaatgtcgttcgatttgattttcgaccttgtgggaatccaacctactttgat<br>ttgtccgacaggtacatcaaagcaagggtaagattcttatgattggcttaggcagatccaagttgtttat<br>tccaaattataaattgggtatccgtgaagtcgagatcattttcaattttggtggtacttcggccgagcaaat<br>tgagtgcatgaaatgggttgcaaaaggcttgatcaaacctaatattcacgtggctgatttttgcttcctgcc<br>tgagtacctcgaggacttggccaagggtaaactcactggtagaattgtatttagaccaagtaagttg |
| SEQ ID NO: 121 | ADH4 (Amino Acid Seq.) | MSLSGKTSLIAAGTKNLGGASAKELAKAGSNLFLHYRSNPDEAE<br>KFKQEILKEFPNVKVETYQSKLDRAADLTNLFAAAKKAFPSGID<br>VAVNFVGKVIKGPITEVTEEQFDEMDVANNKIAFFFIKEAAINLN<br>KNGSIISIVTSLLPAYTDSYGLYQGTKGAVEYYSKSISKELIPKGIT<br>SNCIGPGPASTSFLFNSETKESVEFFKTVAIDQRLTEDSDIAPIVLF<br>LATGGRWATGQTIYASGGFTAR |
| SEQ ID NO: 122 | ADH4 (Nucleic Acid Seq.) | Atgtcattatcaggaaagacctcattaattgctgctggtaccaagaacttgggtggtgcaagtgccaaa<br>gaattggccaaagccggctccaacctcttcttgcactacagatccaacccagacgaggctgaaaagtt<br>caagcaagagatcctcaaggagttccctaacgtcaaggtcgaaacctaccaatccaaattggaccgtg<br>ccgccgacctcaccaacttgtttgctgctgccaagaaggcattccctagtggtattgacgtcgctgtcaa<br>ctttgtcggtaaggtcatcaagggcccaatcactgaggtcactgaagacagtttgacgagatggatgt<br>tgccaacaacaagattgccttttcttcatcaaggaggccgctatcaacttgaacaagaacgtagtatc<br>atttccatcgttactagtttgctcccagcttacaccgattcttacggtttgtaccagggtactaaggagct<br>gttgaatactattcgaaatctatcctgaaggagttgattccaaagggtatcaccagtaactgtattggtcct<br>ggtcctgcttctacttccttttttgtttaattccgaaaccaaggagagtgttgagttcttcaagaccgttgctat<br>tgaccaacgtttgactgaagacagcgacattgccccaattgtgttgttcctcgccactggaggtcgttgg<br>gcaactggtcaaactatttacgctagtggtggtttcactgctcgt |
| SEQ ID NO: 123 | ADH5 (Amino Acid Seq.) | MSLVLKRLLPIRSPTLLNSKFIQLQSQIRTMAIPATQTGFFFTKQE<br>GLNYRTDIPVRKPQAGQLLLKVNAVGLCHSDLHVIDKELECGD<br>NYVMGHEIAGTVAEVGPEVEGYKVGDRVACVGPNGCVCKHC<br>LTGNDNVCKTAFLDWFGLGSDGGYEEYLLVRRPRNLVKVPDN<br>VSIEEAAAITDAVLTPYHAVKTAKVKPTSNVLVIGAGGLGGNGI<br>QIVKAFGGKVTVVDKKDKARDQAKALGADEVYSEIPASIEPGTF<br>DVCLDFVSVQATYDLCQKYCEPKGIIIPVGLGATKLTIDLADLDL<br>REITVTGTFWGTANDLREAFDLVSQGKIKPIVSHAPLKELPNYM<br>EKLKQGAYEGRVVFHP |

TABLE 40-continued

| SEQ ID NO: | Description | Sequence |
|---|---|---|
| SEQ ID NO: 124 | ADH5 (Nucleic Acid Seq.) | Atgtcacttgtcctcaagcgattacttccaatcagatctcctactttactcaattcgaagttcatacagttac aatctcaaattcgcacaatggctatccccgctactcaaactggattcttcttcaccaaacaagaaggttta aactacagaaccgacattcctgtccgcaagccacaagccggtcagttgttgttgaaggtcaatgccgtt ggtctctgccactcggacttgcacgtgattgacaaggagcttgaatgtggtgacaactatgtcatgggc cacgaaattgccggtaccgttgctgaagttggtcccgaagttgaaggctacaaggttggcgaccgtgt cgcttgtgttggtcctaacgggtgcggtgtctgtaagcactgcttgactggtaacgacaatgtctgtaag actgattcctcgactggttcgggttgggctccgatggtgggtacgaagagtacttgttggtgagaaga ccaagaaacttggttaaggtcccggacaacgtctcgattgaggaggctgctgctatcactgatgctgtg ttgactccttaccatgctgtcaagactgccaaggtcaagccaaccagtaacgttttggttattggtgctgg tggattaggtggtaacggtatccagattgtcaaggctttggcggtaaggttactgttgtcgataagaag gataaggcacgtgaccaagctaaggctttgggtgctgatgaagtctacagtgaaatcccagcaagtatt gaaccgggtacattgatgtctgtcagattagtaccgtgcaagccacctatgatctctgccaaaagtact gtgagccaaagggtatcattatcccagagggagggtgctaccaagctcaccattgataggcagata ggatctccgtgaaatcacggaactggtaccactgggaactgccaatgacttgagagaggcgatgat aggaagtcaaggtaagatcaagccgattgatcacatgccccattgaaggagagccaaactatatgg agaagttgaagcagggagcatatgaaggaagagagtcaccaccca |
| SEQ ID NO: 125 | ADH7 (Amino Acid Seq.) | MTVDASSVPDKFQGFASDKRENWEHPKLISYDRKQLNDHDVVL KNETCGLCYSDIHTLRSTWGPYGTNELVVGHEICGTVIAVGPKV TEFKVGDRAGIGAASSSCRHCSRCTHDNEQYCKEQVSTYNSVDP KAAGYVTKGGYSSHSIADELFVFKVPDDLPFEYASPLFCAGITTF SPLYRNLVGSDKDATGKTVGIIGVGGLGHLAIQFASKALNAKVV AFSRSSSKKEEALELGAAEFVATNEDKNWTSRYEDQFDLILNCA SGIDGLNLSDYLSVLKVDKKFVSVGLPPIDDEFNVSPFTFLKQGA SFGSSLLGSKAEVNIMLELAAKHNIRPWIEKVPISEENVAKALKR CFEGDVRYRFVFTEFDKAFGN |
| SEQ ID NO: 126 | ADH7 (Nucleic Acid Seq.) | atgactgagacgcacactgaccagacaagaccaagggatgcctccgacaagagagaaaactggg aacacccaaagttgatctcctacgacagaaagcaactcaatgaccacgacgagtcagaagaacgag acctgtggtagtgaactcggacatccacaccagcgaccacgtgggaccatacggcaccaatgag cagtcgaggccacgaaatctgtggtaccgtcattgctgtcggtccaaaggtcactgagacaaggtcg gtgacagagccggtattggtgctgcctcacgtcagtcgtcactgaccagatgtacccacgataacga gcaatactgtaaggaacaagtctccacttacaaactgagatccaaaggccgctggaacgtcaccaag ggtggttactcctccactccatcgctgacgaattgatgtcacaaggttccagatgacttgccattcgag tacgcaccccattaactgtgctggtatcacaactactcccattgtaccgtaacaggagggtccgata agacgccactggtaagaccgaggtcattggtgaggtggtcaggtcaccagccatccagtagcg tctaaagcatgaacgctaaggtcgagctactccagatcctcctccaagaaggaagaagctctcgaatt gggtgctgctgagtagtcgccaccaacgaagacaagaactggacccagcagatacgaggaccaattc gacctcatcagaactgtgcgagcggtatcgatggcagaacagtctgactacttgagtgtcagaaagt cgacaagaagtagtctctggagatgccaccaatcgacgacgagacaacgtctctccatcactacag aagcaaggtgccagatcggtagaccagagggatccaaggctgaagtcaacatcatgaggaaagg ctgccaagcacaacatcagaccatggattgaaaaggtcccaatcagtgaggaaaacgtcgccaagg catgaagagatgattgaaggtgatgtcagatacagattcgtcacactgagatgacaaagcttaggca at |
| SEQ ID NO: 127 | ADH8 (Amino Acid Seq.) | MSVPTTQKAVIFETNGGKLEYKDVPVPVPKPNELLVNVKYSGV CHSDLHVWKGDWPIPAKLPLVGGHEGAGVVVGMGDNVKGWK VGDLAGIKWLNGSCMNCEFCQQGAEPNCSRADMSGYTHDGTF QQYATADAVQAAKIPEGADMASIAPILCAGVTVYKALKNADLL AGQWVAISGAGGGLGSLGVQYAKAMGYRVLAIDGGDERGEFV KSLGAEVYIDFLKEQDIVSAIRKATGGGPHGVINVSVSEKAINQS VEYVRTLGKVVLVSLPAGGKLTAPLFESVARSIQIRTTCVGNRK DTTEAIDFFVRGLIDCPIKVAGLSEVPEIFDLMEQGKILGRYVVDT SK |
| SEQ ID NO: 128 | ADH8 (Nucleic Acid Seq.) | Atgtccgttccaactactcagaaagctgttatctttgaaaccaatggtggcaagttagaatacaaagac gtgccggtccctgtccctaaacccaacgaattgcttgtcaacgtcaagtactcgggtgtgtgtcattctg acttgcatgtctggaaaggcgactggcccattcctgccaagttgccttggtgggaggtcacgaaggt gctggtcgttgtcggcatgggtgacaacgtcaagggctggaaggtggggacttggctggtatca agtggttgaatggttcgtgtatgaactgtgagttttgccaacagggcgcagaacctaactgttcaagagc cgacatgtctgggtatacccacgatggaactttccaacaatacgccactgctgatgctgtccaagctgc caagatcccagaaggcgccgacatggctagtatcgccccgatctttgtgcgctggtgtgaccgtgtaca aggctttgaagaacgccgacttgttggctggccaatgggtggctatctctggtgctggtggtggtttgg gctccttgggtgtgcagtacgctaaagccatgggttacagagtgttggctatcgacggtggtgacgag agaggagagtttgtcaagtccttgggcgccgaagtgtacattgacttccttaaggaacaggacatcgtt agtgctatcagaaaggcaactggtggtggtccacacggtgttattaacgtctcagtgtccgaaaaggca atcaaccagtcggtggagtacgtcagaactttgggggaaagtggttttagttagcttgcccggcaggtggt aaactcactgctcctcttttcgagtctgttgctagatcaatccagattagaactacgtgtgttggcaacaga aaggatactactgaagctattgatttctttgttagaggggttgatcgattgcccaattaaagtcgctggtttaa gtgaagtgccagagattttgacttgatggagcagggaaagatcttgggtagatatgtcgttgatacgtc aaag |
| SEQ ID NO: 129 | SFA1 (Amino Acid Seq.) | MSESTVGKPITCKAAVAWEAGKPLTIEDVTVAPPKAHEVRIKIL YTGVCHTDAYTLSGVDPEGAFPVILGHEGAGIVESVGEGVTTVK PGDHVIALYTPECGECKFCKSGKTNLCGKIRATQGKGVMPDGTP |

TABLE 40-continued

| SEQ ID NO: | Description | Sequence |
|---|---|---|
| | | RFTCKGKELIHFMGCSTFSQYTVVTDISVVAINDKAELDKACLL<br>GCGITTGYGAATITANVQKGDNVAVFGGGAVGLSVLQGCKERE<br>AAQIILVDVNNKKKEWGEKFGATAFINPLELPKGVTIVDKLIEMT<br>DGGCDFTFDCTGNVNVMRDALEACHKGWGTSVIIGVAAAGKEI<br>STRPFQLVTGRVWKGAAFGGVKGRSQLPGIVEDYMVGKLKVEE<br>FITHRKPLEQINEAFEDMHAGDCIRAVVNMW |
| SEQ ID NO: 130 | SFA1 (Nucleic Acid Seq.) no introns | atgtctgaatcaaccgttggaaaaccaatcacctgtaaagccgctgttgcctgggaagcaggcaagcc<br>tttgaccatcgaagacgtcactgttgctccaccaaaggcccacgaagtgcgtatcaagatcttgtacact<br>ggtgtctgtcacactgatgcctacaccttgagtggtgttgatccagagggtgccttcccagtcatcttgg<br>gacacgaaggtgccggtattgttgaaagtgttggtgaaggtgtcaccactgtcaagccaggcgaccac<br>gtcattgcattatacactccagaatgtggtgagtgtaagttctgtaaatcgggtaagaccaacttgtgtgg<br>taaaatcagagctacccaaggcaaaggtgtgatgccagacggaactccaagattcacttgcaagggc<br>aaagaattgattcactttatgggatgctccaccttctcccaatacaccgttgtcactgacatttccgtcgtg<br>gccatcaacgacaaagccgaacttgacaaggcttgtttgttgggatgtggtatcactactggttatggtg<br>ctgccaccatcactgccaatgttcaaaagggtgacaatgtcgcagttttcggtggtggtgctgtcggatt<br>gtccgtcctccaaggatgtaaagaaagagaagctgcccaaatcattttggttgatgtcaacaacaagaa<br>gaaggaatggggtgaaaagttcggtgccactgcttttatcaacccattagaattaccaaaaggcgtcac<br>tattgttgacaagttgattgaaatgactgacggtggttgtgactttacttttgactgtaccgtaatgtcaat<br>gttatgagagatgccttggaagcttgtcataaggggttggggtacttcagtcatcatcggtgttgccgctg<br>ccggtaaggaaatctccaccagaccattccaattggtcactggtagagtctggaagggtgctgctttcg<br>gtggcgtcaagggtagatcccaattgccaggaatcgttgaagactacatggttggtaagttgaaggttg<br>aagagtttatcacccacagaaaaccattggaacaaatcaatgaagcatttgaagacatgcatgctggtg<br>attgtattgagagctgttgtcaacatgtgg |
| SEQ ID NO: 131 | FAO1, Candida (Nucleic Acid Seq.) | atggctccattttttgcccgaccaggtcgactacaaacacgtcgacacccttatgttattatgtgacgggat<br>catccacgaaaccaccgtcgaccaaatcaaagacgttattgctcctgacttccctgctgacaagtacga<br>agagtacgtcaggacattcaccaaaccctccgaaaccccagggttcagggaaaccgtctacaacaca<br>gtcaacgcaaacaccacggacgcaatccaccagttcattatcttgaccaatgttttggcatccagggtct<br>tggctccagctttgaccaactcgttgacgcctatcaaggacatgagcttggaagaccgtgaaaaattgtt<br>ggctcgctggcgcgactcccaatcgctgccaaaaggaagttgttcaggttggttttctacgcttaccttg<br>gtcacgttcacgagattggccaatgagttgcatttgaaagccattcattatccaggaagagaagaccgt<br>gaaaaggcttatgaaacccaggagattgacccttttaagtaccagttttttggaaaaaccgaagttttacg<br>gcgctgagttgtacttgccagatattgatgtgatcattattggatctggtgccggtgctggtgttgtggcc<br>cacactttggccaacgatggcttcaagagtttggttttggaaaagggcaaatacttttagcaactccgagt<br>tgaactttgatgacaaggacggcgttcaagaattataccaaagtggaggtactttgactacagtcaacc<br>aacagttgtttgttcttgctggttccacttttggtggcggtaccactgtcaattggtcagcctgtcttaagac<br>gccattcaaggtcgtaaggaatggtatgatgagtttggtgttgactttgctgctgatgaagcatacgata<br>agcgcaggattatgtttggcagcaaatgggagcttctaccgaaggcatcacccactcctttggctaacg<br>agattattattgaaggtggtaagaaattaggttacaaggccaaggtattagaccaaaacagcggtggtc<br>atcctcagcacagatgcggtttctgttatttgggctgtaagcacggtatcaagcagggtctgttaataac<br>tggtttagagacgcagctgcccacggttcccagttcatgcaacaggttagagtttgcaaatacttaaca<br>agaaggggatcgcttacggtatcttgtgtgaggatgttgtaaccgggcgccaagttcaccattactggcc<br>ccaaaaagtttgttgttgctgccggtgctttgaacactccatcgtgttggtcaactccggcttcaagaac<br>aagaacatcggtaagaacttaactttgcacccagtttctgtcgtgtttggtgattttggcaaagacgttcaa<br>gcagaccacttccacaactccatcatgactgcccttgttcagaagccgctgatttagacggcaagggc<br>catggatgcagaattgaaaccatcttgaacgctcatcatccaggcttcattcttaccatggagaggta<br>gtaacgaggctagacgagacttgttgcgttacaacaacatggtggcgatgttgctccttagtcgtgaca<br>ccaccagtggttccgtttctgctcatccaaccaaacctgaagcttgttgtcgagtacgacgtgaacaa<br>gtttgacagaaactcgatcttgcaggcattgttggtcactgctgacttgttgtatatcaaggtgccaaga<br>gaatccttagtccacaggcatggtgccaatttttgaatccgacaagccaaaggataagagatcaatca<br>aggacgaggactatgtcgaatggagagccaaggttgccaagattcattcgacacctacggctcacct<br>tatggttcggcacatcaaatgtcttcttccgctgtgtcaggtaagggtcctaaatacggtgctgttgacac<br>cgatggtagattgtttgaatgttcgaatgtttatgttgccgatgcaagtcttttgccaactgcaagcggtgc<br>caaccctatggtcaccaccatgactcttgccagacatgttgcgttaggtttggcagactccttgaagacc<br>aaagccaagttgtag |
| SEQ ID NO: 132 | FAO1, Candida (Amino Acid Seq.) | MAPFLPDQVDYKHVDTLMLLCDGIIHETTVDQIKDVIAPDFPAD<br>KYEEYVRTFTKPSETPGFRETVYNTVNANTTDAIHQFIILTNVLA<br>SRVLAPALTNSLTPIKDMSLEDREKLLASWRDSPIAAKRKLFRLV<br>STLTLVTFTRLANELHLKAIHYPGREDREKAYETQEIDPFKYQFL<br>EKPKFYGAELYLPDIDVIIIGSGAGAGVVAHTLANDGFKSLVLEK<br>GKYFSNSELNFDDKDGVQELYQSGGTLTTVNQQLFVLAGSTFG<br>GGTTVNWSACLKTPFKVRKEWYDEFGVDFAADEAYDKAQDYV<br>WQQMGASTEGITHSLANEIIEGGKKLGYKAKVLDQNSGGHPQH<br>RCGFCYLGCKHGIKQGSVNNWFRDAAAHGSQFMQQVRVLQIL<br>NKKGIAYGILCEDVVTGAKFTIGPKKFVVAAGALNTPSVLVNS<br>GFKNKNIGKNLTLHPVSVVFGDFGKDVQADHFHNSIMTALCSE<br>AADLDGKGHGCRIETILNAPFIQASFLPWRGSNEARRDLLRYNN<br>MVAMLLLSRDTTSGSVSAHPTKPEALVVEYDVNKFDRNSILQAL<br>LVTADLLYIQGAKRILSPQAWVPIFESDKPKDKRSIKDEDYVEW<br>RAKVAKIPFDTYGSPYGSAHQMSSCRMSGKGPKYGAVDTDGRL<br>FECSNVYVADASLLPTASGANPMVTTMTLARHVALGLADSLKT<br>KAKL |
| SEQ ID NO: 133 | FAO1Δpts1, Candida | atggctccattttttgcccgaccaggtcgactacaaacacgtcgacacccttatgttattatgtgacgggat<br>catccacgaaaccaccgtcgaccaaatcaaagacgttattgctcctgacttccctgctgacaagtacga |

TABLE 40-continued

| SEQ ID NO: | Description | Sequence |
|---|---|---|
| | (Nucleic Acid Seq.) | agagtacgtcaggacattcaccaaaccctccgaaaccccagggttcagggaaaccgtctacaacaca gtcaacgcaaacaccacggacgcaatccaccagttcattatcttgaccaatgttttggcatccaggtct tggctccagcttttgaccaactcgttgacgcctatcaaggacatgagcttggaagaccgtgaaaaattgtt ggcctcgtggcgcgactcccaatcgctgccaaaaggaagttgttcaggttggtttctacgcttaccttg gtcacgttcacgagattggccaatgagttgcatttgaaagccattcattatccaggaagagaagaccgt gaaaaggcttatgaaacccaggagattgacccttttaagtaccagttttttggaaaaaccgaagttttacg gcgctgagttgtacttgccagatattgatgtgatcattattggatctggtgccggtgctggtgttgtggcc cacactttggccaacgatggcttcaagagtttggttttggaaaagggcaaatactttagcaactccgagt tgaactttgatgacaaggacggcgttcaagaattataccaaagtggaggtactttgactacagtcaacc aacagttgtttgttcttgctggttccacttttggtggcggtaccactgtcaattggtcagcctgtcttaagac gccattcaaggtgcgtaaggaatggtatgatgagttggtgttgactttgctgctgatgaagcatacgata aagcgcaggattatgtttggcagcaaatgggagcttctaccgaaggcatcacccactctttggctaacg agattattattgaaggtggtaagaaattaggttacaaggccaaggtattagaccaaaacagcggtggtc atcctcagcacagatgcggtttctgttattgggctgtaagcacggtatcaagcagggttctgttaataac tggtttagagacgcagctgcccacggttcccagttcatgcaacaggttagagttttgcaaatacttaaca gaaggggatcgcttacggtatcttgtgtgaggatgttgtaaccggcgccaagttcaccattactggcc ccaaaaagttgttgttgctgccggtgctttgaacactccatctgtgttggtcaactccggcttcaagaac aaggaacatcggtaagaacttaacttttgcacaactccatcgatgcccttttgttcagaagccgctgatttaga cggcaagggccatggatgcagaattgaaaccatcttgaacgctccattcatccaggcttcattcttaccatggaga ggtagtaacgaggctagacgagacttgttgcgttacaacaacatggtggcgatgttgctccttagtcgtgaca ccaccagtggttccgtttctgctcatccaaccaaacctgaagctttggttgtcgagtacgacgtgaacaa gtttgacagaaactcgatcttgcaggcattgttggtcactgctgacttgttgtatatccaaggtgccaaga gaatccttagtccacaggcatgggtgccaattttgaatccgacaagccaaaggataagagatcaatca aggacgaggactatgtcgaatgagagccaaggttgccaagattcattcgacacctacggctcacct tatggtcggcacatcaaatgtctcttgccgtatgtcaggtaagggcctaaatacggtgctgttgacac cgatggtagattgttgaatgttcgaatgtttatgttgccgatgcaagtctttgccaactgcaagcggtgc caaccctatggtcaccaccatgactcttgccagacatgttgcgttaggttggcagactccttgaagacc aaaatag |
| SEQ ID NO: 134 | FAO1Δpts1,, Candida (Amino Acid Seq.) | MAPFLPDQVDYKHVDTLMLLCDGIIHETTVDQIKDVIAPDFPAD KYEEYVRTFTKPSETPGFRETVYNTVNANTTDAIHQFIILTNVLA SRVLAPALTNSLTPIKDMSLEDREKLLASWRDSPIAAKRKLFRLV STLTLVTFTRLANELHLKAIHYPGREDREKAYETQEIDPFKYQFL EKPKFYGAELYLPDIDVIIIGSGAGAGVVAHTLANDGFKSLVLEK GKYFSNSELNFDDKDGVQELYQSGGTLTTVNQQLFVLAGSTFG GGTTVNWSACLKTPFKVRKEWYDEFGVDPAADEAYDKAQDYV WQQMGASTEGITHSLANEIIIEGGKKLGYKAKVLDQNSGGHPQH RCGFCYLGCKHGIKQGSVNNWFRDAAAHGSQFMQQVRVLQIL NKKGIAYGILCEDVVTGAKFTITGPKKFVVAAGALNTPSVLVNS GFKNKNIGKNLTLHPVSVVFGDFGKDVQADHFHNSIMTALCSE AADLDGKGHGCRIETILNAPFIQASFLPWRGSNEARRDLLRYNN MVAMLLLSRDTTSGSVSAHPTKPEALVVEYDVNKFDRNSILQAL LVTADLLYIQGAKRILSPQAWVPIFESDKPKDKRSIKDEDYVEW RAKVAKIPFDTYGSPYGSAHQMSSCRMSGKGPKYGAVDTDGRL FECSNVYVADASLLPTASGANPMVTTMTLARHVALGLADSLKT K |
| SEQ ID NO: 135 | ALD1, Candida (Amino Acid Seq.) | MLSRVLFKTKPRVPTKSITAMAIRNKSIVTLSSTTSTYPTDHTTPS TEPYITPSFVNNEFIKSDSNTWFDVHDPATNYVVSKVPQSTPEEL EEAIASAHAAFPKWRDTSIIKRQGIAFKFVQLLRENMDRIASVIV LEQGKTFVDAQGDVTRGLQVAEAACNITNDLKGESLEVSTDME TKMIREPLGVVGSICPFNFPAMVPLWSLPLVLVTGNTAVIKPSER VPGASMIICELAAKAGVPPGVLNIVHGKHDTVNKLIEDPRIKALT FVGGDKAGKYIYEKGSSLGKRVQANLGAKNHLVVLPDAHKQSF VNAVNGAAFGAAGQRCMAISVLVTVGKTKEWVQDVIKDAKLL NTGSGFDPKSDLGPVINPESLTRAEEIIADSVANGAVLELDGRGY RPEDARFAKGNFLGPTILTNVKPGLRAYDEEIFAPVLSVVNVDTI DEAIELINNNKYGNGVSLFTSSGGSAQYFTKRIDVGQVGINVPIP VPLPMFSFTGSRGSFLGDLNFYGKAGITFLTKPKTITSAWKTNLI DDEILKPSTSMPVQQ |
| SEQ ID NO: 136 | ALD1, Candida (Nucleic Acid Seq.) | atgttatccagagttctttcaagactaaaccaagagttcctactaaatcaatcaccgccatggccatcag aaacaaatccatcgtgactttatcctccaccacctccacataccaaccgaccacacgaccccgtccac ggagccatacatcacgccatccttcgtgaacaacgagttcatcaagtcggactccaacacctggttcga cgtgcacgacccggccacgaactacgtcgtgtccaaggtgccacagtcgacgccggaggagttgga agaagcaatcgcgtcggcccacgccgcgttccccaaatggcgcgacaccagcatcatcaagcgtca agggatcgcgttcaagtttgtgcagttgttgcgcgagaacatggacagaatcgcaagcgtcattgtcctt gaacaaggtaagacgtttgtcgatgcccagggtgacgtgactagaggattacaggttgctgaggctg cgtgcaacatcactaacgacttgaaaggtgagtcgttggaagtctctactgatatggagaccaagatga ttagagaaccctttgggtgttgtgggatccatctgtcctttttaacttcccagctatggtccattgtggtctttg cctttggttttggtcacgggtaacaccgctgtgattaagccttcgagagagtcccggggcgcaagtatg attatttgtgaattggccgcaaggcaggtgttcaactaggtgtgttgaacattgtccacggtgacaagcc acaccgtcaacaagttgatcgaggacccaagaatcaaggcattgacttttgtcggtggtgacaaggcc ggtaagtacatttacgaaaagggttccagtttgggcaagagagtgcaggccaacttgggtgctaagaa ccacttggttgtgttgccagacgcacacaagcagagttttgtcaatgccgtcaacggtgccgcttcggt gctgctggacagagatgtatggctatttctgtcttggtcaccgtgggtaagaccaaggaatgggtgcag gatgtcatcaaggacgccaagttgttgaacaccggaagtggatttgacccaaagagtgacttgggtcc |

TABLE 40-continued

| SEQ ID NO: | Description | Sequence |
|---|---|---|
| | | agtcatcaacccagagtccttgactcgtgctgaagaaatcattgctgattccgtggccaacggtgccgt gttggaattggacggaagaggatacagaccagaagacgccagattcgccaagggtaacttcttgggt ccaaccatcttgaccaacgtcaagccgggcttgagagcatacgacgaggagattttcgctcctgattgt cggtggtaacgtcgacaccattgacgaagccattgagttgatcaacaataacaagtacggtaacggt gtttcattatttacttcctccggtggctcagcccagtatttcactaagagaatcgatgtcggccaagtcggt atcaatgtcccaatccctgttccattgcctatgttctccttcactggttccagaggctccttcttgggtgactt gaacttctacggtaaggccggtatcaccttcttgaccaagccaaagaccatcactagtgcctggaaga ccaacttgattgatgacgagatcttgaaaccatctacctcgatgcctgtccaacag |
| SEQ ID NO: 137 | ALD5, Candida (Amino Acid Seq.) | MSLPVVTKLTTPKGLSYNQPLGLFINNEFVVPKSKQTFEVFSPST EEKITDVYEALAEDVDVAAEAAYAAYHNDWALGAPEQRAKILL KLADLVEEHAETLAQIETWDNGKSLQNARGDIGFTAAYFRSCG GWADKNTGDNINTGGTHLTYTQRVPLVCGQIIPWNASTLMASW KLGPVIATGGTTVLKSAEATPLAVLYLAQLLVEAGLPKGVVNIV SGFGTTAGSAIASHPKIDKVAFTGSTNTGKIIMKLAAESNLKKVT LELGGKSPHIVFNDADLDRAVSYLVAAIFSNSGETCAAGSRVLV QSGVYDEVVAKFKKGAEAVKVGDPFDEETFMGSQVNEVQLSRI LQYIESGKEQGATVVTGGGRAGDKGYFVKPTIFADVHKDMTIV KEEIFGPVVSVVKFDTIEEAIALANDSEYGLAAGIHTTNISTGVTV ANRIKSGTVVVVNTYNDLHPMVPFGGFGASGIGREMGAEVMKE YTEVKAVRIKLT |
| SEQ ID NO: 138 | ALD5, Candida (Nucleic Acid Seq.) | atgtattgccagtcgtcaccaaactcactactcctaagggtctctcctacaaccaaccattaggtttgttc atcaacaacgagttcgttgttccaaaatccaagcaaaccttcgaagtcttctcccttccaccgaagaga agatcaccgatgtctacgaagctttagccgaagatgtcgacgttgctgccgaagcagcttacgccgcc taccacaacgactgggccctcggtgctccagaacaaagagccaagattcttgctcaagttggccgactt ggtcgaagaacacgccgagaccttggcccagatcgaaacctgggacaacgtaagtcctttgcagaa cgccagaggcgatatcggattcactgccgcttactttagatcctgtggtggatgggccgacaagaaca ccggtgacaacatcaacaccggtggcacccaccttacttacacccagagagtcccattggtgtgtggt caaatcatcccttggaacgcaagtaccttgatggccagttggaagcttggtcccgttatcgctaccggtg gtaccgctgtcttaaatcagctgaagctaccccaattagctgtcttgttcgtcgcccaattgttagttgaag ccggtcttccaaagggtgtcgttaacattgtttccggttcggtaccactgccggttccgctatcgctagc catccaaagatcgacaaggtcgcctttactggttccaccaacaccggtaagatcatcatgaagttggct gcggagtccaacttgaagaaggtcactttggaattgggtggtaagtccccacacattgttttcaacgac gctgacttggaccgcgccgtcagctacttggttgctgccattttcagtaactccggcgagacctgtgctg ccggatcccgtgtcttggtgcaatccggtgtctacgacgaagttgttgctaagttcaagaagggcgccg aggccgttaaagttggtgacccattcgacgaagaaaccttcatgggttcccaagtcaacgaagtccaat tgtctagaatcttgcaatacatcgagctgggtaaggaacaaggtgccactgttgtcaccggtggtggta gagccggggacaaaggttacttcgtcaagccaactattttcgccgacgttcacaaggacatgactatc gtcaaggaagaaatctttggtcctgttgtctccgtcgtcaaattcgataccattgaagaagctatcgcttg gctaacgactccgaatacggtttggccgctggtatccacaccactaacatcagcaccggtgtcaccgt cgctaacagaatcaagtccggtactgtctgggtcaacacttacaatgacttgcaccccatggttccattc ggtggtttcggcgcttctggtatcggcagagaaatgggtgcagaagtcatgaaggaatacaccgaagt taaggctgttagaattaagctcact |
| SEQ ID NO: 139 | HFD1, Candida (Amino Acid Seq.) | MSKSYKLPKSSKISPIVKGKTSAKSKSSSKTPSPPSGSPPTSARIAA PELEPVEQTSDNELPATKVAVRRSSSASSKSTNGSAAATSAAAA NAAAPQKTPVEAKPAPKPEPVQSKGNDNDSDDSKLDTAESYVD VKKETEALVESKSVASTVDDTSVLQYTPLSEIPGGVKRVVDGFH TGKTHPLEFRLKQLRNLYFAVRDNQEAICDALSKDFHRVSSETR NYELVTGLNELLYTMSQLHKWSKPLPVDELPLNLMINPTYVERI PVGTVLVIAAFNYPLFVSISPIAGAIAAGNTVVFKPSELTPHFSKL FTDLMAKALDPDVFYAVNGSVPETTELLNQKFDKIIYTGSETVG KIIAKKAAETLTPVILELGGKSPAFVLDDVADKDLPIVARRIAWG RYANAGQTCIGVDYVLVAKSKHDKFIKALRDVIEKEFFPNVDAN SNFTHLIHDRAFHKMKNIIDKTTGKIIIGGQMDSASRYVSPTVIDD ATWDDSSMQEEIFGPILPVLTYTDLTDACRDVVSHHDTPLAEYIF TSGSTSRKYNSQINTIATIIRSGGLVINDVLMHIALHNAPFGGIGK SGHGAYHGEFSYRAFTHERTVLEQNLWNDWIIKSRYPPYSNKK DRLVASSQGKYGGRVWFGRQGDVKIDGPSTFFSAWTNVLGVA GVVCDFIGASL |
| SEQ ID NO: 140 | HFD1, Candida (Nucleic Acid Seq.) | atgagtaagtcatacaagttgccaaaatcatctaagatctcgcctatcgtaaagggtaagacctcggca aaatcaaaaagtagctcaaaaaccaccatcaccaccactgcagtccccaccaacatcagccaggatcg ctgcgcctgaattggaaccggtcgaacaaacatccgacaacgagctcccagctactaaagttggcgtt cgcagaagcagcagcgcttcatcgaagtcaaccaacgggtccgcggctgccacttctgccgctgctg ccaatgctgctgcccccacaaaaaactccagttgaagcaaagccagcccctaagccagagccagttca gtccaagggtaacgacaacgactccgatgactccagttagacaccgctgaatcatatgtcgacgtga agaaagaaaccgaagctctcgttgagtcaaagtcggttgcttcaacagtcgatgatacttctgtcttgca gtacacccgttatctgagatccctggcggcgtcaagagagttgtcgatgggttccacaccggcaaga cccaccccattggagtttagattgaagcaattgagaaacttgtacttcgccgtgagggataaccaagaag ccatctgtgacgcctgagcaaggattttccaccgtgtctctgaaactgaaaagaaactgaatt ggttac cggggttgaatgaattgttgtacacgatgtcgcaattgcacaaggtggagcaagccattgccagtggatga gttgccattgaacttgatgatcaacccactctatgttgaaagaatcccagttggtaccggtcttggtcatcgc cgctttcaactatccattgtttgtttcgatttcccctattgccggtgccattgctgctggtaacactgttgtgtt caagccatctgaattgactccgcacttttcaagttgttcactgatttgatggctaaagcgttggacccag atgtcttttatgccgtgaacggtccgtgcctgaaactaccgagttgttgaaccagaagttcgacaagat |

TABLE 40-continued

| SEQ ID NO: | Description | Sequence |
|---|---|---|
| | | catttacaccggtagtgaaactgttggtaagatcattgccaagaaggcggccgagacgttgacgccag<br>tgattttggaacttggaggcaaatcgccagcctttgttttggacgacgttgccgacaaagacttgccaatt<br>gttgcgcgtcgtattgcttggggaagatatgctaatgctggacagacctgtattggtgttgattatgtgttg<br>gttgcaaagtccaaacacgacaagttcatcaaggctttgagggatgttattgagaaagagttcttcccca<br>atgttgacgctaacagcaactttacccatttgatccacgacagggcattccacaaaatgaagaacatcat<br>tgacaaaaccacagggaagataatcatccggtggtcaaatggatagtgcttccaggtatgtctccaccac<br>tgtgattgacgatgctacctgggacgactcgtccatgcaggaggaaatatttggccctatcttgccggtt<br>ctcacttatactgaccttactgatgcatgtcgtgacgttgtttctcaccatgatactccgttggctgaataca<br>tcttcaccagcgggtccacttcaagaaagtacaactcgcagatcaacaccattgctactatcatcagatc<br>cggtgggttagtcataaatgatgtgttgatgcacattgccttgcacaacgctccgttcggtggtattggta<br>aatctggacatggtgcctaccacggagaattctcctacagggcttttaccacgagagaaccgttcttg<br>aacaaaacttgtggaatgactggatcattaagtcaagatacccaccatattccaataagaaagacaggtt<br>ggttgctagttcacaaggcaagtatggtggaagagtttggttcggacgtcaaggtgatgtcaagattga<br>cggaccatccacgttcttctcggcatggaccaatgtccttggtgtagctggtgtagtgtgatttattgg<br>tgcctctttg |
| SEQ ID NO: 141 | HFD2, Candida (Amino Acid Seq.) | MSPPSKLEDSSSATTAADTLGDSWYTKVSDIAPGVQRLTESFHR<br>DQKTHDIQFRLNQLRNLYFAVQDNADALCAALDKDFYRPPSET<br>KNLELVGGLNELVHTISSLHEWMKPEKVTDLPLTLRSNPIYIERIP<br>LGVVLIISPFNYPPFLSFSAVVGAIAGGNAVVLKGSELTPNFSSLF<br>SKILTKALDPDIFFAVDGAIPETTELLEQKFDKIMYTGNNTVGKII<br>AKKAAETLTPVILELGGKSPAFILDDVKDKNLEVIARRIAWGRFT<br>NAGQTCVAVDYVLVPTKLHKKFIAALTKVLSQEFYPNLTKDTK<br>GYTHVIHDRAFNNLSKIISTTKGDIVFGGDTDAATRFIAPTVIDNA<br>TWEDSSMKGEIFGPILPVLTYDKLTTAIRQVVSTHDTPLAQYIFTS<br>GSTSRKYNRQLDQILTGVRSGGVIVNDVLMHVALINAPFGGVG<br>DSGYGSYHGKFSRSFTHERTTMEQKLWNDGMVKVRYPPYNS<br>NKDKLIQVSQQNYNGKVWFDRNGDVPVNGPGALFSAWTTFTG<br>VFHLLGEFITNKQ |
| SEQ ID NO: 142 | HFD2, Candida (Nucleic Acid Seq.) | atgtccccaccatctaaattagaagactcctcctccgcaaccaccgctgccgataccttggcgactcc<br>tggtacaccaaagtgtccgacattgcgcctggcgtgcagagattgaccgagtcattccacagggatca<br>aaagacgcacgacattcagttccgcttgaaccaattgcgtaaccttactttgcggtccaggacaatgcc<br>gacgcgctctgtgctgccttggacaaggacttctaccgtcccccagtgaaaccaagaacttggaact<br>cgtgggtggcttgaatgagttggtgcacaccattcgagcttgcatgagtggatgaagccggaaaaag<br>tcacggatttgccacttactttgaggtcaaacccgatttatattgaaagaatcccattgggggtcgtgttga<br>tcatctcgccttttcaactacccttcttcttgtcgttttcggccgtcgtgggtgcgattgctggtggtaacgc<br>ggttgttttgaagggctctgagttgacgccaaacttctccagtttgttctcaaagatcttgactaaggcttt<br>gaccctgatattttattgcagtcgatggtgctatccctgagcagaccgagttgttggaacaaaagtttga<br>caagatcatgtatactggtaacaacaccgtgggtaagattattgccaagaaggtgctgagaccttgac<br>gccagttatcttggaattgggtggtaagtcgccagctttcatcttggacgacgtcaaggataaaaacttg<br>gaagtcatcgccagaagaatcgcatggggtagattcaccaacgccggtcaaacctgtgttgctgtcga<br>ctacgtcttggttccaaccaaactccacaagaagttcattgctgcgttgaccaaggtcttgagtcaagaa<br>ttctaccctaacttgaccaaagacaccaagggctacacccacgtcatccacgaccgtgcattcaacaat<br>ttgtccaagatcatcagcaccaccaagggtgacattgtctttggcggcgacaccgatgccgccacccg<br>cttcatcgccccaccgtcatcgacaacgccacctgggaggattcttccatgaagggcgaaatctttgg<br>tcccatcttgccgtcttgacctacgacaagctcaccaccgccatcaggcaagttgtgtccacgcacga<br>cacgccattagccgcagtacatcttcaccagcgggtccacatcccgcaagtacaacgccagctcgac<br>cagatcttgactggtgtccggtccgggggtgtgattgtcaacgatgtcttgatgcacgttgcgttgatca<br>atgcgccatttggcggcgttggtgactccgggtacggctcgtaccacggcaagttctcgttccgcagct<br>tcacgcacgaactaccaccatggagcagaagttgtggaacgacgggatggtcaaggtcagatacc<br>ctccttataactccaacaagacaagttgatccaggtctcccagcgaactacaacggcaaggtctggt<br>tcgatagaaacggcgacgtgcctgtgaatggaccaggtgcgttgtttagcgcttggactacgttcactg<br>gtgtcttccatttgcttggtgagttcatcactaataagcaataga |
| SEQ ID NO: 143 | MAE1 (non-mitochondrial), Candida (Amino Acid Seq.) | MVSSTATASATSGEMRTVKTPVGIKAAIESLKPKATRVSMDGPV<br>ECPLTDFALLNSPQFNKGSAFSLEERKSFKLTGLLPSQVNTLDEQ<br>VERAYRQFTYLKTPLAKNDFCTSMRLQNKVLYYELVRRNIREM<br>LPIIYTPTEGDAIASYSDRFRKPEGCFLDINDPDNIDERLAAYGEN<br>KDIDYIVMSDGEGIXXXSDRFRKPEGCFLDINDPDNIDERLAAYG<br>ENKDIDYIVMSDGEGILGIGDQGVGGIRIAIAKLGLMTLCGGIHP<br>ARVLPITLDVGTNNDRLLNDDLYMGNKFPRVRGERYWDFVDK<br>VIHAITKRFPSAVMHYEDFGVTTGRDMLHKYRTALPSFNDDIQG<br>TGAVVMASITAALKFSNRSLKDIEVLIYGAGSAGLGIADQITNHL<br>VSHGATPEQARSRIHCMDRYGLITTESNNASPAQMNYADKASD<br>WEGVDTSSLLACVEKVKPTVLVGCSTQAGAFTEEVVKTMYKY<br>NPQPIIFPLSNPTRLHEAVPADLMKWTDNNALIATGSPFEPVDGY<br>YISENNNCFTFPGIGLGAVLSRCSTISDTMISAAVDRLASMSPKM<br>ENPKNGLLPRLEEIDEVSAHVATAVILQSLKEGTARVESEKKPDG<br>GYVEVPRDYDDCLKWVQSQMWKPVYRPYIKVEYVSNIHTYQY |
| SEQ ID NO: 144 | MAE1 (non-mitochondrial), Candida (Nucleic Acid Seq.) | atggtctcctccacggccaccgcatccgccacgtcaggggaaatgcgtaccgtcaagaccccagtgg<br>ggatcaaggcggccatcgaatcattaaaaccaaaagctactagagtctccatggacggacctgtcgaa<br>tgcccattgaccgatttcgccttgttgaactccctcaattcaacaaaggttcggcattttcttggaagaa<br>aggaaaagtttcaagttgaccgggctcctcccttctcaagtcaacactttggatgaacaggttgaaaga<br>gcctatagacaattcacatacttgaagaccccattggccaagaacgatttctgcacgtctatgagattgc<br>agaacaaagtgctttactacgagttggttagaagaaatatccgtgagatgttgcccatcatctacaccccc |

TABLE 40-continued

| SEQ ID NO: | Description | Sequence |
|---|---|---|
| | | aaccgaaggggacgccatcgccagttattccgacaggttcagaaaaccagagggctgtttcttggata<br>tcaacgaccccgacaacatcgatgagagattagctgcctatggggagaacaaagacatagattacatt<br>gtcatgagtgacggagaaggtatcnnnnnnnnctccgacaggttcagaaaaccagagggctgcttc<br>ttggacatcaatgacccagacaacatcgacgagagattggctgcctatggggagaacaaagacatag<br>attacattgtcatgagtgacggagaaggtatcctcggtattggagaccaaggcgtcggtggtatcagaa<br>ttgccattgctaaattggggttgatgaccctttgtggtggtattcacccggccagagttttgcccatcacttt<br>ggatgttggtacaaataacgacaggttgttgaatgatgatttgtacatgggcaacaagttccctagagtc<br>agaggagaaagatactgggactttgtcgataaggtcatacacgcaattacgaaacggttcccaagtgc<br>cgtgatgcattacgaagatttcggagtcacaactggtagggacatgttgcacaagtaccgtacggctct<br>tccttcttttcaacgacgacatccaaggtaccggtgtgtcatggcatcgatcacagctgccttgaag<br>ttctccaaccgtagcctaaaggacatcgaggttttgatttacggtgccggctcagctggtttaggtattgc<br>tgaccagatcaccaaccacttggtcagccacgcgctactccagaacaagccagatctaggatccatt<br>gtatggaccgttatggggttgatcacaactgaatccaacaacgccagtcctgctcaaatgaactacgccg<br>acaaggcatctgattgggaaggtgtcgatacctcgagtctacttgcctgtgttgaaagtcaaaccaa<br>ctgtcttggttgggtgttccactcaggcaggtgcattcaccgaagaggagtcaaaaccatgtacaagta<br>caacccacagccaattatttcccattgtccaaccctaccagattgcatgaagccgtgccggctgatttg<br>atgaaatggaccgacaacaacgcgttgattgccaccggttctccatttgaacctgtcgatggctactaca<br>tttccgaaaacaacaactgtttcaccttcccaggtattgggttgggtgctgtcttgtccagatgtagcacc<br>atttcggataccatgatttctgccgccgttgatagattggcttcgatgtcgccaaagatggagaacccaa<br>agaacggattgttgcctagattggaagaaatcgacgaagtcagtgcccatgttgccacggctgttatctt<br>gcaatctttgaaggaaggcaccgctagagtcgaaagcgagaagaagccagacggtggttacgttga<br>agttccaagagactatgatgattgtcttaagtgggtgcaatcacaaatgtggaagccagtgtacagacc<br>atacatcaaggttgagtacgtttcgaatattcacacctatcaatat |
| SEQ ID NO: 145 | PYC2, Sc (Amino Acid Seq.) | MPESRLQRLANLKIGTPQQLRRTSIIGTIGPKTNSCEAITALRKAG<br>LNIIRLNFSHGSYEFHQSVIENAVKSEQQFPGRPLAIALDTKGPEI<br>RTGRTLNDQDLYIPVDHQMIFTTDASFANTSNDKIMYIDYANLT<br>KVIVPGRFIYVDDGILSFKVLQIIDESNLRVQAVNSGYIASHKGV<br>NLPNTDVDLPPLSAKDMKDLQFGVRNGIHIVFASFIRTSEDVLSI<br>RKALGSEGQDIKIISKIENQQGLDNFDEILEVTDGVMIARGDLGIE<br>ILAPEVLAIQKKLIAKCNLAGKPVICATQMLDSMTHNPRPTRAE<br>VSDVGNAVLDGADCVMLSGETAKGDYPVNAVNIMAATALIAE<br>STIAHLALYDDLRDATPKPTSTTETVAAAATAAILEQDGKAIVVL<br>STTGNTARLLSKYRPSCPIILVTRHARTARIAHLYRGVFPPFLYEPK<br>RLDDWGEDVHRRLKFGVEMARSFGMVDNGDTVVSIQGFKGGV<br>GHSNTLRISTVGQEF* |
| SEQ ID NO: 146 | PYC2, Sc (Nucleic Acid Seq.) | ATGCCAGAGTCCAGATTGCAGAGACTAGCTAATTTGAAAATA<br>GGAACTCCGCAGCAGCTCAGACGCACCTCCATAATAGGTACC<br>ATTGGGCCCAAGACAAATAGCTGCGAGGCCATTACTGCTCTG<br>AGAAAAGCTGGTTTGAACATCATTCGATTGAACTTTTCCCATG<br>GCTCCTACGAATTCCATCAATCAGTAATCGAAAATGCTGTGA<br>AATCGGAACAGCAATTCCCTGGCAGGCCGCTCGCCATTGCCC<br>TGGATACCAAGGGTCCCGAGATCAGAACAGGTCGCACGTTAA<br>ATGACCAAGATCTTTATATCCCCGTAGACCACCAAATGATCTT<br>TACCACTGACGCAAGTTTTGCAAACACCTCCAATGATAAAAT<br>CATGTATATAGACTATGCTAACCTGACAAAAGTTATCGTTCC<br>GGGGAGATTTATATACGTGGACGACGGGATTCTCTCTTTTAA<br>AGTGCTCCAAATCATTGACGAATCTAATTTAAGGGTGCAAGC<br>GGTAAACTCGGGTTATATCGCATCTCATAAAGGTGTTAATCT<br>GCCTAATACCGACGTTGATTTGCCCCCCTTGTCCGCCAAAGAC<br>ATGAAGGACTTGCAATTCGGAGTCCGCAATGGCATTCACATC<br>GTATTTGCCTCTTTCATAAGAACTTCAGAAGATGTGTTGTCTA<br>TCAGAAAAGCGTTGGGTTCTGAAGGGCAAGATATCAAGATTA<br>TATCCAAGATAGAAAACCAGCAAGGGTTGGATAATTTTGACG<br>AAATCCTGGAAGTCACGGATGGTGTTATGATAGCGAGAGGCG<br>ATTTAGGAATTGAAATCCTGGCACCTGAAGTATTAGCCATTC<br>AAAAAAAGCTGATTGCAAAATGTAATTTGGCGGGCAAACCTG<br>TCATTTGCGCGACTCAGATGCTGGATTCAATGACACACAATC<br>CGAGACCGACAAGGGCTGAAGTATCGGATGTGGGTAACGCT<br>GTGTTGGATGGTGCTGATTGTGTTATGCTTTCTGGAGAAACGG<br>CGAAGGGTGATTATCCGGTGAATGCAGTTAATATTATGGCGG<br>CGACCGCTCTGATTGCTGAAAGTACTATCGCTCATTTGGCTCT<br>TTATGACGATCTCAGAGACGCCACTCCCAAACCTACTTCCACT<br>ACGGAAACTGTAGCAGCTGCAGCTACCGCAGCAATCTTGGAG<br>CAAGATGGTAAGGCCATCGTTGTATTATCTACTACAGGGAAC<br>ACGGCAAGGCTACTGTCGAAGTATAGACCAAGCTGCCCTATC<br>ATATTAGTAACAAGACACGCAAGAACGGCAAGAATTGCGCA<br>TTTGTATAGAGGTGTTTTCCCATTTCTGTATGAACCGAAACGC<br>CTAGACGACTGGGGTGAGGATGTTCATAGGCGCCTAAAGTTT<br>GGTGTTGAAATGGCGAGGTCTTTCGGAATGGTGGACAACGGT<br>GATACTGTTGTTTCCATTCAAGGATTCAAAGGAGGAGTCGGC<br>CATTCCAATACCTTACGCATTTCTACTGTTGGTCAAGAATTCT<br>AG |
| SEQ ID NO: 147 | FAT1 S244A, ATCC20336 | atgtcaggattagaaatagccgctgctgccatccttggtagtcagttattggaagccaaatatttaattgc<br>cgacgacgtgctgttagccaagacagtcgctgtcaatgccctcccatacttgtggaaagccagcagag |

TABLE 40-continued

| SEQ ID NO: | Description | Sequence |
|---|---|---|
| | (Nucleic Acid seq.) | gtaaggcatcatactggtacttttttcgagcagtccgtgttcaagaacccaaacaacaaagcgttggcgtt<br>cccaagaccaagaaagaatgcccccaccccccaagaccgacgccgagggattccagatctacgacg<br>atcagtttgacctagaagaatacacctacaaggaattgtacgacatggattgaagtactcatacatcttg<br>aagaacgagtacggcgtcactgccaacgacaccatcggtgttcttgtatgaacaagccgcttttcattg<br>tcttgtggttggcattgtggaacattggtgccttgcctgcgttcttgaacttcaacaccaaggacaagcca<br>ttgatccactgtcttaagattgtcaacgcttcgcaagttttcgttgaccggactgtgattccccaatcaga<br>gataccgaggctcagatcagagaggaattgccacatgtgcaaataaactacattgacgagtttgccttg<br>tttgacagattgagactcaagtcgactccaaaacacagagccgaggacaagaccagaagaccaacc<br>gatactgactcctccgcttgtgcattgatttacaccgcgggtaccaccggtttgccaaaagccggtatca<br>tgtcctggagaaaagccttcatggcctcggttttcttggccacatcatgaagattgactcgaaatcgaac<br>gtcttgaccgccatgcccttgtaccactccaccgcgggcatgttgggtttgtgtcctactttgattgtcgg<br>tggctgtgtctccgtgtcccagaaattctccgctacttcgttctggacccaggccagattatgtggtgcca<br>cccacgtgcaatacgtcggtgaggtctgtcgttacttgttgaactccaagcctcatccagaccaagaca<br>gacacaatgtcagaattgcctacggtaacggttgcgtccagatatatggtctgagttcaagcgcagat<br>tccacattgaaggtatcggtgagttctacgccgccaccgagtcccctatcgccaccaccaacttgcagt<br>acggtgagtacggtgtcggcgcctgtcgtaagtacgggtccctcatcagcttgttattgtctacccagca<br>gaaattggccaagatggacccagaagacgagagtgaaatctacaaggaccccaagaccgggttctg<br>taccgaggccgcttacaacgagccaggtgagttgttgatgagaatcttgaaccctaacgacgtgcaga<br>atccttccagggttattatggtaacaagtccgccaccaacagcaaaatcctcaccaatgttttcaaaaa<br>aggtgacgcgtggtacagatccggtgacttgttgaagatggacgaggacaaattgttgtactttgtcga<br>cagattaggtgacacttttccgttggaagtccgaaaacgtctccgccaccgagtcgagaacgaattga<br>tgggctccaaggccttgaagcagtccgtcgttgtcggtgtcaaggtgccaaaccacgaaggtagagc<br>ctgttttgccgtctgtgaagccaaggacgagttgagccatgaagaaatcttgaaattgattcactctcac<br>gtgaccaagtattgcctgtgtatgctcaacctgcgttcatcaagattggcaccattgaggcttcgcacaa<br>ccacaaggttcctaagaaccaattcaagaacaaaagttgccaaagggtgaagacggcaaggatttg<br>atctactggttgaatggcgacaagtaccaggagttgactgaagacgattggtctttgatttgtaccggta<br>aagccaaattgtag |
| SEQ ID NO: 148 | FAT1 S244A, ATCC20336 (Amino Acid seq.) | msgleiaaaailgsqlleakyliaddvslaktvavnalpylwkasrgkasywyffeqsvfknpnnk<br>alafprprknaptpktdaegfqiyddqfdleeytykelydmvlkysyilkneygvtandtigvscm<br>nkplfivlwlalwnigalpaflnfntkdkplihclkivnasqvfvdpdcdspirdteaqireelphvq<br>inyidefalfdrlrlkstpkhraedktrrptdtdssacaliytagttglpkagimswrkafmasvffghi<br>mkidsksnyltamplyhstaamlglcptlivggCvsysqkfsatsfwtqarlcgathvqyvgevc<br>ryllnskphpdqdrhnvriaygnglipdiwseflurfhiegigefyaatespiattnlqyegygvga<br>crkygslislllstqqklakmdpedeseiykdpktgfcteaaynepgellmrilnpndvqksfqgy<br>ygnksatnskiltnvfkkgdawyrsgdllkmdedkllyfvdrlgdtfrwksenvsateevenelmg<br>skalkqsvvvgvkvpnhegracfavceakdelsheeilklihshvtkslpvyaqpafikigtieash<br>nhhkvpknqfknqklpkgedgkdliywingdkyqelteddwslictgkakl |
| SEQ ID NO: 149 | FAT1 D495A, ATCC20336 (Nucleic Acid seq.) | atgtcaggattagaaatagccgctgctgccatccttggtagtcagttattggaagccaaatatttaattgc<br>cgacgacgtgctgttagccaagacagtcgctgtcaatgccctcccatacttgtggaaagccagcagag<br>gtaaggcatcatactggtacttttttcgagcagtccgtgttcaagaacccaaacaacaaagcgttggcgtt<br>cccaagaccaagaaagaatgcccccaccccccaagaccgacgccgagggattccagatctacgacg<br>atcagtttgacctagaagaatacacctacaaggaattgtacgacatggattgaagtactcatacatcttg<br>aagaacgagtacggcgtcactgccaacgacaccatcggtgttcttgtatgaacaagccgcttttcattg<br>tcttgtggttggcattgtggaacattggtgccttgcctgcgttcttgaacttcaacaccaaggacaagcca<br>ttgatccactgtcttaagattgtcaacgcttcgcaagttttcgttgaccggactgtgattccccaatcaga<br>gataccgaggctcagatcagagaggaattgccacatgtgcaaataaactacattgacgagtttgccttg<br>tttgacagattgagactcaagtcgactccaaaacacagagccgaggacaagaccagaagaccaacc<br>gatactgactcctccgcttgtgcattgatttacacctcgggtaccaccggtttgccaaaagccggtatcat<br>gtcctggagaaaagccttcatggcctcggttttcttggccacatcatgaagattgactcgaaatcgaac<br>gtcttgaccgccatgcccttgtaccactccaccgcgggcatgttgggtttgtgtcctactttgattgtcgg<br>tggctgtgtctccgtgtcccagaaattctccgctacttcgttctggacccaggccagattatgtggtgcca<br>cccacgtgcaatacgtcggtgaggtctgtcgttacttgttgaactccaagcctcatccagaccaagaca<br>gacacaatgtcagaattgcctacggtaacgggtgcgtccagatatatggtctgagttcaagcgcagat<br>tccacattgaaggtatcggtgagttctacgccgccaccgagtcccctatcgccaccaccaacttgcagt<br>acggtgagtacggtgtcggcgcctgtcgtaagtacgggtccctcatcagcttgttattgtctacccagca<br>gaaattggccaagatggacccagaagacgagagtgaaatctacaaggaccccaagaccgggttctg<br>taccgaggccgcttacaacgagccaggtgagttgttgatgagaatcttgaaccctaacgacgtgcaga<br>atccttccagggttattatggtaacaagtccgccaccaacagcaaaatcctcaccaatgttttcaaaaa<br>aggtgacgcgtggtacagatccggtgccttgttgaagatggacgaggacaaattgttgtactttgtcga<br>cagattaggtgacacttttccgttggaagtccgaaaacgtctccgccaccgagtcgagaacgaattga<br>tgggctccaaggccttgaagcagtccgtcgttgtcggtgtcaaggtgccaaaccacgaaggtagagc<br>ctgttttgccgtctgtgaagccaaggacgagttgagccatgaagaaatcttgaaattgattcactctcac<br>gtgaccaagtcttttgcctgtgtatgctcaacctgcgttcatcaagattggcaccattgaggcttcgcacaa<br>ccacaaggttcctaagaaccaattcaagaacaaaagttgccaaagggtgaagacggcaaggatttg<br>atctactggttgaatggcgacaagtaccaggagttgactgaagacgattggtctttgatttgtaccggta<br>aagccaaattgtag |
| SEQ ID NO: 150 | FAT1 D495A, ATCC20336 (Amino Acid seq.) | Msgleiaaaailgsqlleakyliaddvslaktvavnalpylwkasrgkasywyffeqsvfknpnnk<br>alafprprknaptpktdaegfqiyddqfdleeytykelydmvlkysyilkneygvtandtigvscm<br>nkplfivlwlalwnigalpaflnfntkdkplihclkivnasqvfvdpdcdspirdteaqireelphvq<br>inyidefalfdrlrlkstpkhraedktrrptdtdssacaliytsgttglpkagimswrkafmasvffghi<br>mkidsksnvltamplyhstaamlglcptlivggcvsysqkfsatsfwtqarlcgathvqyvgevcr<br>yllnskphpdqdrhnvriaygnglipdiwseflurfhiegigefyaatespiattnlqyegygvgac<br>rkygslislllstqqklakmdpedeseiykdpktgfcteaaynepgellmrilnpndvqksfqgyy<br>gnksatnskiltnvfkkgdawyrsgallkmdedkllyfvdrlgdtfrwksenvsatevenelmgs |

TABLE 40-continued

| SEQ ID NO: | Description | Sequence |
|---|---|---|
| | | kalkqsvvvgvkvpnhegracfavceakdelsheeilklihshvtkslpvyaqpafikigtieashn hkvpknqfknqklpkgedgkdliywingdkyqelteddwslictgkakl |
| SEQ ID NO: 151 | SFA1 (Nucleic Acid Seq.) genomic | atgtctgaatcaaccgttggaaaagtatgtcacctta acaattgagtctcgtaattgctcgccattgggaa atcatcggctgtatttataatccagatattcctaccctagtagttaccacagaacaattgcaacagaataa atactaacctttttgtcttagccaatcacctgtaaagccgctgttgcctgggaagcaggcaagcctttgac catcgaagacgtcactgttgctccaccaaaggcccacgaagtgcgatcaagatcttgtacactggtgt ctgtcacactgatgcctacaccttgagtggtgttgatccagagggtgccttcccagtcatcttgggacac gaaggtgccggtattgttgaaagtgttggtgaaggtgtcaccactgtcaagcaggcgaccacgtcatt gcattatacactccagaatgtggtgagtgtaagttctgtaaatcgggtaagaccaacttgtgtgtaaaat cagagctacccaaggcaaaggtgtgatgccagacggaactccaagattcacttgcaagggcaaaga attgattcactttatgggatgctccaccttctcccaatacaccgttgtcactgacatttccgtcgtggccatc aacgacaaagccgaacttgacaaggcttgtttgttgggatgtggtatcactactggttatggtgctgcca ccatcactgccaatgttcaaaagggtgacaatgtcgcagtttttcggtggtggtgctgtcgtcggattgtccgt cctccaaggatgtaaagaaagaagctgcccaaatcattttggttgatgtcaacaacaagaagaagg aatgggggtgaaaagttccggtgccactgcttttatcaacccattagaattaccaaaaggcgtcactattgtt gacaagttgattgaaatgactgacggtggttgtgactttacttttgactgtaccggtaatgtcaatgttatg agagtgccttgaaagcttgtcataaggtgggtacttcagtcatcatcggtgttgccgctgccggta aggaaatctccaccagaccattccaattggtcactggtagagtctggaagggtgctgattcggtggcg tcaagggtagatcccaattgccaggaatcgttgaagactacatggttggtaagttgaaggttgaagagtt tatcacccacagaaaaccattggaacaaatcaatgaagcatttgaagacatgcatgctggtgattgtatt agagctgttgtcaacatgtgg |
| SEQ ID NO: 152 | ADH1-1short, Candida (Amino Acid Seq.) | MSANIPKTQKAVVFEKNGGELEYKDIPVPTPKANELLINVKYSG VCHTDLHAWKGDWPLATKLPLVGGHEGAGVVVGMGENVKG WKIGDFAGIKWLNGSCMSCEFCQQGAEPNCGEADLSGYTHDGS FEQYATADAVQAARIPAGTDLAEVAPILCAGVTVYKALKTADL AAGQWVAISGAGGGLGSLAVQYAVAMGLRVVAIDGGDEKGAF VKSLGAEAYIDFLKEKDIVSAVKKATDGGPHGAINVSVSEKAID QSVEYVRPLGKVVLVGLPAGSKVTAGVFEAVVKSIEIKGSYVGN RKDTAEAVDFFSRGLIKCPIKIVGLSELPQVFKLMEEGKILGRYV LDTSK |
| SEQ ID NO: 153 | ADH1-1short, Candida (Nucleic Acid Seq.) | atgtctgctaatatcccaaaaactcaaaaagctgtcgtctttgagaagaacggtggtgaattagaataca aagatatcccagtgccaacccaaaggccaacgaattgctcatcaacgtcaaatactcgggtgtctgc cacactgatttgcacgcctggaaggggtgactggccattggccaccaagttgccattggttggtggtcac gaaggtgctggtgtcgttgtcggcatgggtgaaaacgtcaagggctggaagattggtgacttcgccgg tatcaaatggttgaacggttcctgtatgtcctgtgagttctgtcaacaaggtgctgaaccaaactgtggtg aggccgacttgtctggttacacccacgatggttattcgaacaatacgccactgctgatgctgttcaagc cgccagaatcccagctggactgatttggccgaagttgccccaatcttgtgtgcgggtgtcaccgtcta caaagccttgaagactgccgacttggccgctggtcaatgggtcgctatctccggtgctggtggtggttt gggttccttggctgtccaatacgccgtcgccatgggcttgagagtcgttgccattgacggtggtgacga aaagggtgcctttgtcaagtccttgggtgctgaagcctacattgatttcctcaaggaaaaggacattgtct ctgctgtcaagaaggccaccgatggaggtccacacggtgctatcaatgtttccgtttccgaaaaagcca ttgaccaatccgtcgagtacgttagaccattgggtaaggttgttttggttggtttgccagctggctccaag gtcactgctggtgttttcgaagccgttgtcaagtccattgaaatcaagggttcctatgtcggtaacagaaa ggataccgccgaagccgttgacttttttctcagagggcttgatcaagtgtccaatcaagattgttggcttga gtgaattgccacaggtcttcaagttgatggaagaaggtaagatcttgggtagatacgtcttggataccct caaa |
| SEQ ID NO: 154 | ADH1-2 short, Candida (Amino Acid Seq.) | MSANIPKTQKAVVFEKNGGELKYKDIPVPTPKANELLINVKYSG VCHTDLHAWKGDWPLDTKLPLVGGHEGAGVVVGMGENVKG WKIGDFAGIKWLNGSCMSCEFCQQGAEPNCGEADLSGYTHDGS FEQYATADAVQAARIPAGTDLAEVAPILCAGVTVYKALKTADL AAGQWVAISGAGGGLGSLAVQYAVAMGLRVVAIDGGDEKGDF VKSLGAEAYIDFLKEKGIVAAVKKATDGGPHGAINVSVSEKAID QSVEYVRPLGKVVLVGLPAGSKVTAGVFEAVVKSIEIKGSYVGN RKDTAEAVDFFSRGLIKCPIKIVGLSELPQVFKLMEEGKILGRYV LDTSK |
| SEQ ID NO: 155 | ADH1-2 short, Candida (Nucleic Acid Seq.) | atgcatgcattattctcaaaatcagttttctcaagtatgtgagtctgcccactacctctgctatccccattc cctagaattcattgtctcccgaagctcctatttaaggagacgaattccccatatcttccacgttgctccca attccttccttctattattcttcttcttcagtctacaccaagaaatcatttcacacaatgtctgctaatatccca aaaactcaaaaagctgtcgtcttcgagaagaacggtggtgaattaaaatacaaagacatcccagtgcc aaccccaaaggccaacgaattgctcatcaacgtcaagtactccggtgtctgtcacactgatttgcacgc ctggaaggggtgactggccattggacaccaagttggttggtggtcacgaaggtgctggtgttgt tgtcggcatgggtgaaaacgtcaagggctggaaaattggtgatttcgccggtatcaaatggttgaacg gttcttgtatgtcctgtgagttctgtcagcaaggtgctgaaccaaactgtggtgaagctgacttgtctggtt acacccacgatggttattcgaacaatacgccactgctgatgctgtgcaagccgccagaatcccagct ggcactgatttggccgaagttgccccaatcttgtgtgctggtgtcaccgtctacaaagccttgaagactg ccgactgctggtcaatgggtcgctatctccggtgctggtggtggtttgggttccttggctgtccaa atacgccgtcgccatgggtttgagagtcgttgccattgacggtggtgacgaaaagggtgactttgtcaa gtccttgggtgctgaagcctacattgatttcctcaaggaaaagggcattgttgctgctgtcaagaaggcc actgatggcggtccacacggtgctatcaatgtttccgtttccgaaaaagccattgaccaatctgtcgagt acgttagaccattgggtaaggttgttttggttggtttgccagctggctccaaggtcactgctggtgttttcg aagccgttgtcaagtccattgaaatcaagggttcttacgtcggtaacagaaaggatactgccgaagcc |

TABLE 40-continued

| SEQ ID NO: | Description | Sequence |
|---|---|---|
| | | gttgacttttctccagaggcttgatcaagtgtccaatcaagattgtgggcttgagtgaattgccacaggt<br>cttcaagttgatggaagaaggtaagatcttgggtagatacgtcttggatacctccaaa |
| SEQ ID NO: 156 | MAE1, Sc (Amino Acid Seq.) in Spec. | MWPIQQSRLYSSNTRSHKATTTRENTFQKPYSDEEVTKTPVGSR<br>ARKIFEAPHPHATRLTVEGAIECPLESFQLLNSPLFNKGSAFTQEE<br>REAFNLEALLPPQVNTLDEQLERSYKQLCYLKTPLAKNDFMTSL<br>RVQNKVLYFALIRRHIKELVPIIYTPTEGDAIAAYSHRFRKPEGVF<br>LDITEPDSIECRLATYGGDKDVDYIVVSDSEGILGIGDQGIGGVRI<br>AISKLALMTLCGGIHPGRVLPVCLDVGTNNKKLARDELYMGNK<br>FSRIRGKQYDDFLEKFIKAVKKVYPSAVLHFEDFGVKNARRLLE<br>KYRYELPSFNDDIQGTGAVVMASLIAALKHTNRDLKDTRVLIYG<br>AGSAGLGIADQIVNHMVTHGVDKEEARKKIFLMDRRGLILQSYE<br>ANSTPAQHVYAKSDAEWAGINTRSLHDVVENVKPTCLVGCSTQ<br>AGAFTQDVVEEMHKHNPRPIIFPLSNPTRLHEAVPADLMKWTN<br>NNALVATGSPFPPVDGYRISENNNCYSFPGIGLGAVLSRATTITD<br>KMISAAVDQLAELSPLREGDSRPGLLPGLDTITNTSARLATAVIL<br>QALEEGTARIEQEQVPGGAPGETVKVPRDFDECLQWVKAQMW<br>EPVYRPMIKVQHDPSVHTNQL* |
| SEQ ID NO: 157 | ZWF1, Scheffersomyces stipitis (Amino Acid Seq.) | MSFDPFGSTATIVVFGASGDLAKKKTFPALFGLFREGHLSSDVKI<br>IGYARSHLEEDDFKKRISANFKGGNPETVEQFLKLTSYISGPYDT<br>DEGYQTLLKSIEDYEAANNVSTPERLFYLALPPSVFTTVASQLKK<br>NVYSETGKTRIIVEKPFGHDLESSRQLQKDLSPLFTEEELYRIDHY<br>LGKEMVKNLLVLRFGNELFNGVWNKNHIKSIQISFKEAFGTDGR<br>GGYFDSIGIVRDVMQNHLLQVLTLLTMDRPVSFDPEAVRDEKV<br>KILKAFDALDPEDILLGQYGKSEDGSKPGYLDDSTVPKDSKCVT<br>YAALGIKIHNERWEGVPIVMRAGKALDESKVEIRIQFKPVARGM<br>FKEIQRNELVIRVQPNESIYLKINSKIPGISTETSLTDLDLTYSTRY<br>SKDFWIPEAYEALIRDCYLGNHSNFVRDDELDVSWKLFTPLLQY<br>IESDKSPQPEVYAYGSKGPKGLREFLNKHDYIFADEGTYQWPLT<br>TPKVKGKI* |
| SEQ ID NO: 158 | ACS2B, Candida (Amino Acid Seq.) (from spec) | MPALFKDSAQHILDTIKSELPLDPLKTAYAVPLENSAEPGYSAIY<br>RNKYSTDKLIDTPYPGLDTLYKLFEVSTEANGDKPCLGGRVKNA<br>DGTFGEYKFQDYNTIHQRRNNLGSGIFFVLQNNPYKTNSEAHSK<br>LKYDPTSKDSFILTIFSHNRPEWALCDLTSIAYSITNTALYDTLGP<br>DTSKYILGLTESPIVVCSKDKIRGLIDLKKNNPDELSNLIVLVSMD<br>DLTTADASLKNYGSEHNVTVYDIKQVEKLGEINPLDPIEPTPDTN<br>FTITFTSGTTGANPKGVLLNHRNAVAGVTFVLSRYDGQFNPTAY<br>SFLPLAHIYERASIQFALTIGSAIGFPQGSPLTLIEDAKVLQPDGL<br>ALVPRVLTKLEAAIRAQTVNNDEKPLVKSVFGAAINAKMEAQM<br>KEENENFNPSFIVYDRLLNLLRKKVGLQKVSQISTGSAPISPSTIQ<br>FLKASLNVGILQGYGLSESFAGCMASSKFEPAAVTCGPPGITTEV<br>KLKDLEEMGYTSKDEGGPRGELLLRGPQIFKEYFKNPEETAEAI<br>DEDGWFHTGDVAKINNKGRISIIDRAKNFFKLAQGEYVTPEKIEG<br>LYLSKFPYIAQIFVHGDSKESYLVGVVGLDPVAGKQYMESRFHD<br>KIIKEEDVVEFFKSPRNRKILLQDMNKSIADQLQGFEKLHNIYVD<br>FDPLTVERGVITPTMKIRRPLAAKFFQDQIDAMYSEGSLVRNGSL |
| SEQ ID NO: 159 | ACS2C, Candida (Amino Acid Seq.) (from spec) | MPALFKDSAKHIFDTIKSELPLDPLKTAYAVPLENSAEPGYSAIY<br>RNKYSIDKLIDTPYPGLDTLYKLFEVATEAYGDKPCLGGRVKNA<br>DGTFGEYKFQDYNTIHQRRNNFGSGIFFVLQNNPYKTDSEAHSK<br>LKYDPTSKDSFILTIFSHNRPEWALCDLTSIAYSITNTALYDTLGP<br>DTSKYILGLTESPIVICSKDKIRGLIDLKKNNPDELSNLIVLVSMD<br>DLTTADASLKNYGSEHNVTVFDIKQVEKLGEINPLDPIEPTPDTN<br>FTITFTSGTTGANPKGVLLNHRNAVAGVTFVLSRYDGHFNPTAY<br>SFLPLAHIYERASIQFALTIGSAIGFPQGSPLTLIEDAKVLQPDGL<br>ALVPRVLTKLEAAIRAQTVNNDEKPLVKSVFGAAINAKMEAQM<br>KEENENFNPSFIVYDRLLNLLRKKVGLQKVTQISTGSAPISPSTIQ<br>FLKASLNVGILQGYGLSESFAGCMASSKFEPAAATCGPTGVTTE<br>VKLKDLEEMGYTSKDEGGPRGELLLRGPQIFKGYFKNPEETAKA<br>IDEDGWFHTGDVAKINDKGRISIIDRAKNFFKLAQGEYVTPEKIE<br>GLYLSKFPYIAQLFVHGDSKESYLVGVVGLDPVAGKQYMESRF<br>HDKIIKEEDVVEFFKSPRNRKILVQDMNKSIADQLQGFEKLHNIY<br>VDFDPLTVERGVITPTMKIRRPLAAKFFQDQIDAMYSEGSLVRN<br>GSL* |
| SEQ ID NO: 160 | PAA073 (Nucleic Acid Seq.) | aaacgccagcaacgcggcctttttacggttcctggccttttgctggcttttgctcacatgttctttcctgc<br>gttatcccctgattctgtggataaccgtattaccgcctttgagtgagctgataccgctcgccagccga<br>acgaccgagcgcagcgagtcagtgagcgaggaagcgagttcggcatggcagatcatcatgcctgca<br>ggagctccaattgtaatatttcgggagaaatatcgttggggtaaaacaacagagagagagggaga<br>gatggttctggtagaattataatcttggttgttgcaaatgctactgatcgactctgacaatgtctagctcg<br>ctagttgtatgcaacttaggtgttatgcatacacacggttattcggttgaattgtggagtaaaaattgtctga<br>gttgtgtcttagctactggctgccccccgcgaaagataatcaaaattacacttgtgaattttttgcacaca<br>caccgattaacatttccctttttttgtccaccgatacacgcttgcctcttcttatttttctctgtgcttccccctcct<br>gtgacttttttccaccattgatataaaatcaactccatttccctaaaatctcccgagattctaaaaacaacttct<br>tctcttctgcttttcttattttgttatatttatttaccatccctttatttttgaatagttattccccactaacattg |

TABLE 40-continued

| SEQ ID NO: | Description | Sequence |
|---|---|---|
| | | ttcaaatcttcacgacataagaagagcccgggtctagatgtgtgctcttccgagtgactcttttgataagagt cgcaaatttgatttcataagtatatattcattatgtaaagtagtaaatggaaaattcattaaaaaaaagcaa atttccgttgtatgcatactccgaacacaaaactagccccggaaaaacccttagttgatagttgcgaattt aggtcgaccatatgcgacgggtacaacgagaattgtattgaattgatcaagaacatgatcttggtgttac agaacatcaagttcttggaccagactgagaatgcacagatatacaaggcgtcatgtgataaaatggatg agatttatccacaattgaagaaagagtttatggaaagtggtcaaccagaagctaaacaggaagaagca aacgaagaggtgaaacaagaagaagaaggtaaataagtattttgtattatataacaaacaaagtaagg aatacagatttatacaataaattgccatactagtcacgtgagatatctcatccattcccaactcccaaga aaaaaaaaagtgaaaaaaaaaatcaaacccaaagatcaacctccccatcatcatcgtcatcaaaccc ccagctcaattcgcaatggttagcacaaaaacatacacagaaagggcatcagcacaccctccaagg ttgcccaacgtttattccgcttaatggagtccaaaaagaccaacctctgcgcctcgatcgacgtgacca caaccgccgagttcctttcgctcatcgacaagctcggtccccacatctgtctcgtgaagacgcacatcg atatcatctcagacttcagctacgagggcacgattgagccgttgcttgtgcttgcagagcgccacgggt tcttgatattcgaggacaggaagtttgctgatatcggaaacaccgtgatgttgcagtacacctcggggt ataccggatcgcggcgtggagtgacatcacgaacgcgcacggagtgactgggaagggcgtcgttga agggttgaaacgcggtgcggaggggtagaaaaggaaaggggcgtgttgatgttggcggagttgtc gagtaaaggctcgttggcgcatggtaatatacccgtgagacgatcgagattgcgaagagtgatcgg gagttcgtgattgggttcatcgcgcagcggacatgggggtagagaagaaggggtttgattggatcat catgacgcctggtgtgggggttggatgataaaggcgatgcgttgggccagcagtataggactgttgatg aggtggttctgactggtaccgatgtgattattgtcgggagagggttgtttggaaaaggaagagaccctg aggtggagggaaagagatacagggatgctggatggaaggcatacttgaagagaactggtcagttag aataaatattgtaataaataggtctatatacatacactaagcttctaggacgtcattgtagtcttcgaagttg tctgctagtttagttctcatgatttcgaaaaccaataacgcaatggatgtagcaggatggtggttagtgc gttcctgac aaacccagagtacgccgcctcaaaccacgtcacattcgcccttttgcttcatccgcatcact tgcttgaaggtatccacgtacgagttgtaatacaccttgaagaacggcttcgtctacgcgcgagacgaa agggcctcgtgatacgcctatttttataggttaatgtcagtgtttaatcgcttgcagctgtcttagacgtcaggtggca ctttttcggggaaatgtgcgcggaaccccctatttgtttatttttctaaatacattcaaatatgtatccgctcatg agacaataaccctgataaatgcttcaataatattgaaaaaggaagagtatgagtattcaacatttccgtgt cgcccttattccctttttttgcggcattttgccttcctgttttgctcacccagaaacgctggtgaaagtaaaa gatgctgaagatcagttgggtgcacgagtgggttacatcgaactggatctcaacagcggtaagatcctt gagagttttcgccccgaagaacgttttccaatgatgagcactttaaagttctgctatgtggcgcggtatt atcccgtattgacgccgggcaagagcaactcggtcgccgcatacactattctcagaatgacttggttga gtactcaccagtcacagaaaagcatcttacggatggcatgacagtaagagaattatgcagtgctgccat aaccatgagtgataacactgcggccaacttacttctgacaacgatcggaggaccgaaggagctaacc gctttttttgcacaacatggggggatcatgtaactcgccttgatcgttgggaaccggagctgaatgaagcc ataccaaacgacgagcgtgacaccacgatgcctgtagcaatggcaacaacgttgcgcaaactattaa ctggcgaactacttactctagcttcccggcaacaattaatagactggatggaggcggataaagttgcag gaccacttctgcgctcggcccttccggctggctggtttattgctgataaatctggagccggtgagcgtg ggtctcgcggtatcattgcagcactggggccagatggtaagccctcccgtatcgtagttatctacacga cggggagtcaggcaactatggatgaacgaaatagacagatcgctgagataggtgcctcactgattaa gcattggtaactgtcagaccaagtttactcatatatactttagattgatttaaaacttcattttttaatttaaaag gatctaggtgaagatccatttgataatctcatgaccaaaatcccttaacgtgagttttcgttccactgagc gtcagaccccgtagaaaagatcaaaggatcttcttgagatccttttttttctgcgcgtaatctgctgcttgca aacaaaaaaaccaccgctaccagcggtggtttgtttgccggatcaagagctaccaactctttttccgaa ggtaactggcttcagcagagcgcagataccaaatactgttcttctagtgtagccgtagttaggccacca cttcaagaactctgtagcaccgcctacatacctcgctctgctaatcctgttaccagtggctgctgccagt ggcgataagtcgtgtcttaccgggttggactcaagacgatagttaccggataaggcgcagcggtcgg gctgaacggggggttcgtgcacacagcccagcttggagcgaacgacctacaccgaactgagatacc tacagcgtgagctatgagaaagcgccacgcttcccgaagggagaaaggcggacaggtatccggtaa gcggcagggtcggaacaggagagcgcacgagggagcttccaggggaaacgcctggtatctttata gtcctgtcgggtttcgccacctctgacttgagcgtcgatttttgtgatgctcgtcaggggggcggagcct atggaa |
| SEQ ID NO: 161 | pAA298 (Nucleic Acid Seq.) | gatctggaatccctcggcgtcggtcttgggggtggggcattctttcttggtcttgggaacgccaacgc tttgttgtttgggttcttgaacacggactgctcgaaaaagtaccagtatgatgccttacctctgctggctttc cacaagtatgggaggcattgacagcgactgtctgtggctaacagcacgtcgtcggcaattaaatatttg gcttccaataactgactaccaaggatggcagcagcggctatttctaatcctgacatgtttctcgtacgtag tagtgaatgaagggaaggtggaataatatcaagggcgaattctgcagatatccatcacactggcggcc gctcgagcatgcatctagagggcccaattcgccctatagtgagtcgtattacaattcactggccgtcgtt ttacaacgtcgtgactgggaaaaccctggcgttacccaacttaatcgccttgcagcacatccccctttcg ccagctggcgtaatagcgaagaggcccgcaccgatcgcccttcccaacagttgcgcagcctatacgt acggcagtttaaggtttacacctataaagagagagccgttatcgtctgtttgtggatgtacagagtgata ttattgacacgccggggcgacggatggtgatccccctggccagtgcacgtctgctgtcagataaagtc tccccgtgaactttacccggtggtgcatatcggtgaaagctggcgcatgatgaccaccgatatggc cagtgtgccggtctccgttatcggggaagaagtggctgatctcagccaccgcgaaatgacatcaaaa acgccattaacctgatgttctggggaatataaatgtcaggcatgagattatcaaaaaggatcttcaccta gatccttttcacgtagaaagccagtccgcagaaacggtgctgaccccggatgaatgtcagctactggg ctatctggacaagggaaaacgcaagcgcaaagagaaagcaggtagcttgcagtgggcttacatggc gatagctagactgggcggttttatggacagcaagcgaaccggaattgccagctggggcgccctctgg taaggttgggaagccctgcaaagtaaactggatggctttctcgccgccaaggatctgatggcgcagg ggatcaagctctgatcaagacaggatgaggatcgtttcgcatgattgaacaagatggattgcacgc aggttctccggccgcttgggtggagaggctattcggctatgactgggcacaacagacaatcggctgct ctgatgccgccgtgttccggctgtcagcgcaggggcgcccggttcttttttgtcaagaccgacctgtccg gtgccctgaatgaactgcaagacgaggcagcgcggctatcgtggctggccacgacgggcgttccttg cgcagctgtgctcgacgttgtcactgaagcgggaagggactggctgctattgggcgaagtgccggg gcaggatctcctgtcatctcaccttgctcctgccgagaaagtatccatcatggctgatgcaatgcggcg gctgcatacgcttgatccggctacctgcccattcgaccaccaagcgaaacatcgcatcgagcgagca |

TABLE 40-continued

| SEQ ID NO: | Description | Sequence |
|---|---|---|
| | | cgtactcggatggaagccggtcttgtcgatcaggatgatctggacgaagagcatcaggggctcgcgc |
| | | cagccgaactgttcgccaggctcaaggcgagcatgcccgacggcgaggatctcgtcgtgacccatg |
| | | gcgatgcctgcttgccgaatatcatggtggaaaatggccgcttttctggattcatcgactgtggccggct |
| | | gggtgtggcggaccgctatcaggacatagcgttggctaccgtgatattgctgaagagcttggcggc |
| | | gaatgggctgaccgcttcctcgtgctttacggtatcgccgctcccgattcgcagcgcatcgccttctatc |
| | | gccttcttgacgagttcttctgaattattaacgcttacaatttcctgatgcggtattttctccttacgcatctgt |
| | | gcggtatttcacaccgcatacaggtggcacttttcggggaaatgtgcgcggaaccccctatttgtttatttt |
| | | ctaaatacattcaaatatgtatccgctcatgagacaataaaccctgataaatgcttcaataatagcacgtga |
| | | ggagggccaccatggccaagttgaccagtgccgttccggtgctcaccgcgcgcgacgtcgccgga |
| | | gcggtcgagttctggaccgaccggctcgggttctccctggacttcgtggaggacgacttcgccggtg |
| | | tggtccgggacgacgtgaccctgttcatcagcgcggtccaggaccaggtggtgccggacaacaccc |
| | | tggcctgggtgtgggtgcgcggcctggacgagcgtacgccgagtggtcggaggtcgtgtccacga |
| | | acttccgggacgcctccgggccggccatgaccgagatcggcgagcagccgtgggggcgggagttc |
| | | gccctgcgcgaccccggccgcaactgcgtgcacttcgtggccgaggagcaggactgacacgtgcta |
| | | aaacttcattttttaatttaaaaggatctaggtgaagatccttttttgataatctcatgaccaaaatcccttaacg |
| | | tgagttttcgttccactgagcgtcagaccccgtagaaaagatcaaaggatcttcttgagatcctttttttctg |
| | | cgcgtaatctgctgcttgcaaacaaaaaaaccaccgctaccagcggtggtttgtttgccggatcaagag |
| | | ctaccaactctttttccgaaggtaactggcttcagcagagcgcagataccaaatactgtccttctagtgta |
| | | gccgtagttaggccaccacttcaagaactctgtagcaccgcctacatacctcgctctgctaatcctgtta |
| | | ccagtggctgctgccagtggcgataagtcgtgtcttaccgggttggactcaagacgatagttaccggat |
| | | aaggcgcagcggtcgggctgaacggggggttcgtgcacacagcccagcttggagcgaacgaccta |
| | | caccgaactgagatacctacagcgtgagctatgagaaagcgccacgcttcccgaagggagaaaggc |
| | | ggacaggtatccggtaagcggcagggtcggaacaggagagcgcacgagggagcttccaggggga |
| | | aacgcctggtatctttatagtcctgtcgggtttcgccacctctgacttgagcgtcgatttttgtgatgctcgt |
| | | caggggggcggagcctatggaaaaacgccagcaacgcggcctttttacggttcctggccttttgctgg |
| | | ccttttgctcacatgttctttcctgcgttatcccctgattctgtggataaccgtattaccgcctttgagtgagc |
| | | tgataccgctcgccgcagccgaacgaccgagcgcagcgagtcagtgagcgaggaagcggaagag |
| | | cgcccaatacgcaaaccgcctctccccgcgcgttggccgattcattaatgcagctggcacgacaggtt |
| | | tcccgactggaaagcgggcagtgagcgcaacgcaattaatgtgagttagctcactcattaggcacccc |
| | | aggctttacactttatgcttccggctcgtatgttgtgtggaattgtgagcggataacaatttcacacagga |
| | | aacagctatgaccatgattacgccaagcttatttaggtgacactatagaatactcaagctatgcatcaagc |
| | | ttggtaccgagctcggatccactagtaacggccgccagtgtgctggaattcgcccttccgttaaacaaa |
| | | aatcagtctgtaaaaaaggttctaaatataattcgtctcagtgtacacattctcccaaaatagtgaaatcc |
| | | agctctacaatttggctttaccggtacaaatcaaagaccaatcgtcttcagtcaactcctggtacttgtcg |
| | | ccattcaaccagtagatcaaatccttgccgtcttcaccctttcgcaacttaggttcttgaattggttcttagg |
| | | aaccttgtggttgtgcgaagcctcaatggtgccaatcttgatgaacgcaggttgagcatacacaggcaa |
| | | agacttggtcacgtgagagtgaatcaatttcaagatttcttcatggctcaactcgtccttggcttcacaga |
| | | cggcaaaacaggctctaccttcgtggtttggcaccttgacaccgacaacgacggactgcttcaaggcc |
| | | ttggagcccatcaattcgttctcggacctcggtgccgagacgttttcggacttccaacggaaagtgtca |
| | | cctaatctgtcgacaaagtacaacaatttgtcctcgtccatcttcaacaagtcaccggatctgtaccacgc |
| | | gtcaccttttttgaaaacattggtgaggattttgctgttggtggcggacttgttaccataataaccctggaa |
| | | ggatttctgcacgtcgttagggttcaagattctcatcaacaactcacctggctcgttgtaagcggcctcg |
| | | gtacagaaccggtcttgggtccttgtagattcactctcgtcttctgggtccatcttggccaatttctgct |
| | | gggtagacaataacaagctgatgagggaccccgtacttacgacaggcgccgacaccgtactcaccgta |
| | | ctgcaagttggtggtggcgataggggactcggtggcggcgtagaactcaccgatccttcaatgtgga |
| | | atctgcgcttgaactcagaccatatatctggacgcaaaccgttaccgtaggcaattctgacattgtgtctg |
| | | tcttggtctggatgaggcttggagttcaacaagtaacgacagacctcaccgacgtattgcacgtgggtg |
| | | gcaccacataatctggcctgggtccagaacgaagtagcggagaattctgggacacggagacacag |
| | | ccaccgacaatcaaagtaggacacaaccccaacatggccgcggtggagtggtacaagggcatggc |
| | | ggtcaagacgttcgatttcgagtcaatcttcatgatgtggccaaagaaaaccgaggccatgaaggctttt |
| | | ctccaggacatgataccggcttttggcaaaccggtggtaccccgagtgtaaatcaatgcacaagcgga |
| | | gagtcagtatcggttggtcttctggtcttgtcctcggctctgtgttttggagtcgacttgagtctcaatctg |
| | | tcaaacaaggcaaactcgtcaatgtagtttatttgcacatgtggcaattcctctctgatctgagcctcggta |
| | | tctctgattggggaatcacagtccgggtcaacgaaaacttgcgaagcgttgacaatcttaagacagtgg |
| | | atcaatggcttgtccttggtgttgaagttcaagaacgcaggcaaggcaccaatgttccacaatgccaac |
| | | cacaagacaatgaaaagcggcttgttcatacaagaaacaccgatggtgtcgttggcagtgacgccgta |
| | | ctcgttcttcaagatgtatgagtacttcaaaaccatgtcgtacaattccttgtaggtgtattcttctaggtcaa |
| | | actgatcgtcgtagatccactagtaacggccgccagtgtgctggaattcgcccttgggctaacgaaaa |
| | | ggaaaccgctgacgttaaaggtatctacggttgtttcggtatgaccccgggggatctgacgggtacaa |
| | | cgagaattgtattgaattgatcaagaacatgatcttggtgttacagacatcaagttcttggaccagactg |
| | | agaatgcacagatatacaaggcgtcatgtgataaaatggatgagatttatccacaattgaagaaagagt |
| | | ttatggaaagtggtcaaccagaagctaaacaggaagaagcaaacgaagaggtgaaacaagaagaa |
| | | gaaggtaaataagtattttgtattatataacaaacaaagtaaggaatacagatttatacaataaattgccat |
| | | actagtcacgtagatactctcatccattcccaactcccaagaaaaaaaaaagtgaaaaaaaaaatca |
| | | aacccaaagatcaacctcccatcatcatcgtcatcaaaccccagctcaattcgcaatggttagcaca |
| | | aaaacatacacagaaagggcatcagcacacccctccnaggttgcccaacgtttattccgcttaatgga |
| | | gtccaaaagaccaacctctgcgcctcgatcgacgtgaccacaaccgccgagttcctttcgctcatcg |
| | | acaagctcggtccccacatctgtctcgtgaagacgcacatcgatntcatctcgactcagctacgagg |
| | | gcacgattgagccgttgcttgtgcttgcagagcgccacgggttcttgatattcgaggacaggaagtttg |
| | | ctgatatcggaaacaccgtgatgttgcagtacacctcgggggtataccggatcgcggcgtggagtga |
| | | catcacgaacgcgcacggagtgactgggaagggcgtcgttgaagggttgaaacgcggtgcggagg |
| | | gggtagaaaaggaaagggcgtgtgatgtnggcgtgaattgtcgggtaaggcctcgttggcgcatg |
| | | gtgaatatacccgtgagacgatcgagattgcgaagagtgatcgggagttcgtgattgggttcatcgcg |
| | | cagcgggacatgggggtagagaagaagggtttgattggatcatcatgacgcctggtgtggggttgg |
| | | atgataaaggcgatgcgttgggccagcagtataggactgttgatgaggtggttctgactggtaccgatg |
| | | tgattattgtcggagagggttgtttggaaaaggaagagaccctgaggtggagggaaagagatacag |
| | | ggatgctggatggaaggcatacttgaagagaactggtcagttagaataaatattgtaataaataggtcta |

TABLE 40-continued

| SEQ ID NO: | Description | Sequence |
|---|---|---|
| | | tatacatacactaagcttctaggacgtcattgtagtcttcgaagttgtctgctagtttagttctcatgatttcg<br>aaaaccaataacgcaatggatgtagcagggatggtggttagtgcgttcctgacaaacccagagtacgc<br>cgcctcaaaccacgtcacattcgcccttcgcttcatccgcatcacttgcttgaaggtatccacgtacgagt<br>tgtaatacaccttgaagaacggcttcgtctacggtcgacgacgggtacaacgagaattgtattgaattga<br>tcaagaacatgatcttggtgttacagaacatcaagttcttggaccagactgagaatgcacagatatacaa<br>ggcgtcatgtgataaaatggatgagatttatccacaattgaagaaagagtttatggaaagtggtcaacca<br>gaagctaaacaggaagaagcaaacgaagaggtgaaacaagaagaagaaggtaaataagtattttgta<br>ttatataacaaacaaagtaaggaatacagatttatacaataaattgccatactagtcacgtgagatatctc<br>atccattccccaactcccaagaaaaaaaaaagtgaaaaaaaaatcaaacccaaagatcaacctccc<br>catcatcatcgtcatcaaaccccagctcaattcgcagagctcggtacccggg |
| SEQ ID NO: 162 | >Piece A (5' untranslated region of FAO1 (from position -500 to -250) (Nucleic Acid Seq.) | gtttgtctatgattccgtttgccttttctttctagtacgagacgttattgaacgaagttttttatatatctagatct<br>aatacatattccatgtctgttcattttttgacggagtttcataaggtggcagtttctaatcaaaggtccgtcatt<br>ggcgtcgtggcattggcggctcgcatcaactcgtatgtcaatattttctgttaactccgccagacatacg<br>atcaaaacctacaagcaaaaaaattccac |
| SEQ ID NO: 163 | >Piece B- URA3 marker (Nucleic Acid Seq.) | cgacgggtacaacgagaattgtattgaattgatcaagaacatgatcttggtgttacagaacatcaagttct<br>tggaccagactgagaatgcacagatatacaaggcgtcatgtgataaaatggatgagatttatccacaat<br>tgaagaaagagtttatggaaagtggtcaaccagaagctaaacaggaagaagcaaacgaagaggtga<br>aacaagaagaagaaggtaaataagtattttgtattatataacaaacaaagtaaggaatacagatttatac<br>aataaattgccatactagtcacgtgagatatctcatccattccccaactcccaagaaaaaaaaaagtga<br>aaaaaaaatcaaacccaaagatcaacctcccccatcatcatcgtcatcaaaccccagctcaattcgca<br>gagctcggtacccggggatcccccatggttagcacaaaaacatacacagaaagggcatcagcacaccccctccaaggttgcccaacgtttatt<br>ccgcttaatggagtccaaaaagaccaacctctgcgcctcgatcgacgtgaccacaaccgccgagttc<br>attcgctcatcgacaagctcggtccccacatcgtctcgtgaagacgcacatcgatatcatctcagactt<br>cagctacgagggcacgattgagccgttgcttgtgcttgcagagcgccacgggttcttgatattcgagga<br>caggaagtttgctgatatcggaaacaccgtgatgttgcagtacacctcgggggtataccggatcgcgg<br>cgtggagtgacatcacgaacgcgcacggagtgactgggaagggcgtcgttgaagggttgaaacgc<br>ggtgcggagggggtagaaaaggaaagggcgtgttgatgttggcggagttgtcgagtaaaggctcg<br>ttggcgcatggtgaatatacccgtgagacgatcgagattgcgaagagtgatcgggagtcgtgattgg<br>gttcatcgcgcagcggacatgggggtagagaagaaagggtttgattggatcatcatgacgcctggt<br>gtggggttggatgataaaggcgatgcgttgggccagcagtataggactgttgatgaggtggttctgact<br>ggtaccgatgtgattattgtcgggagagggttgtttggaaaaggaagagaccctgaggtggagggaa<br>agagatacagggatgctggatgaaggcatacttgaagagaactggtcagttagaataaatattgtaat<br>aaataggtctatatacatacactaagcttctaggacgtcattgtagtcttcgaagttgtctgctagtttagtt<br>ctcatgatttcgaaaaccaataacgcaatggatgtagcagggatggtggttagtgcgttcctgacaaac<br>ccagagtacgccgcctcaaaccacgtcacattcgccattgcttcatccgcatcacttgcttgaaggtat<br>ccacgtacgagttgtaatacaccttgaagaacggcttcgtct |
| SEQ ID NO: 164 | >Piece C (Nucleic Acid Seq.) | Gttaactccgccagacatacgatcaaaacctacaagcaaaaaaattccac |
| SEQ ID NO: 165 | >Piece D- Promoter PDX4 (Nucleic Acid Seq.) | Gagctccaattgtaatatttcgggagaaatatcgttggggtaaaacaacagagagagagagggagag<br>atggttctggtagaattataatctggttgttgcaaatgctactgatcgactctggcaatgtctgtagctcgct<br>agttgtatgcaacttaggtgttatgcatacacacggttattcggttgaattgtggagtaaaaattgtctgag<br>ttgtgtcttagctactggctggccccccgcgaaagataaatcaaaattacacttgtgaattttgcacacac<br>accgattaacatttccctttttgtccaccgatacacgcttgcctcttctttttttctctgtgcttccccctcct<br>gtgacttttccaccattgatataaaatcaactccatttccctaaaatctcccagattctaaaaacaacttct<br>tctcttctgcttttccttatttttgttataattattaccatcccttattttgaatagttattccccactaacattg<br>ttcaaatcttcacgacata |
| SEQ ID NO: 166 | >Piece- Promoter PEX11 (Nucleic Acid Seq.) | Gaagatgaagcgtatgagtattatgagtactgtcggacgttggaaggtggcagagttaagcccgaga<br>aagcaaggaaggagtgggagatgatgagtgatgcggccaaagaggatgtgaaggctgcgtatctgtt<br>tttgatagctggtggtagccgaatagaggaaggcaagcttgttcatattggatgatgatggtagatggtg<br>gctgccaaagtggttgtaaatagaaaagtgggtttgggtctgttgatagttagtggtggcggctgtct<br>gtgattacgtcagcaagtagcacctcggcagttaaaacagcagcaacagaaaaaaaatgtgtgaaagt<br>ttgattccccacagtctaccacacccagagttccatttatccataatatcacaagcaatagaaaaataaa<br>aaattatcaacaaatcacaacgaaaagattctgcaaattattttcacttcttcttttgacttcctcttcttcttg<br>ttaggttcttccatattttccccttaaacccatacacaacgcagcc |
| SEQ ID NO: 167 | >Piece- Promoter TEF1 (Nucleic Acid Seq.) | Ctagcaaaggcttgatcagagaaagcaacaaaaaaaaaactctaatactccagaatacactcctttta<br>gaaacacacaacaaacaagcctagactaccatggactacgatgaagacgatttagattacatttctcaa<br>ggagaagaggaagagtttgacgaaacaagttgaacaacgaagagtacgacttgttgcatgacatgc<br>ttccggagttgaagacaaaattgaaagattacaatgatgagatcccagattacgatttaaaggaagcgtt<br>atactacaactatttcgagatagaccctaccattgaagaattgaagacgaaattcaaaaagagtacgtat<br>ataactaacatcaacgcctttctagtttctgttctgtctccaatgcttctcctggtttcttcatggttctctct<br>gtaccaacaaggaaaaaaaaaaaatctggcaaaaaaaaaccaaaccaaccaatgttcttactcaccaa<br>cgccctacaatc |
| SEQ ID NO: 168 | >Piece E- First 250 bp of the coding | atggctccatttttgcccgaccaggtcgactacaaacacgtcgacacccttatgttattatgtgacgggat<br>catccacgaaaccaccgtggacgaaatcaaagacgtcattgccctgacttccccgccgacaaatac<br>gaggagtacgtcaggacattcaccaaaccctccgaaacccagggttcagggaaaccgtctacaaca |

TABLE 40-continued

| SEQ ID NO: | Description | Sequence |
|---|---|---|
| | sequence of FAO1. (Nucleic Acid Seq.) | ccgtcaacgcaaacaccatggatgcaatccaccagttcattatct |
| SEQ ID NO: 169 | >PGKpromoter_Candida_ATCC20336 | ttgtccaatgtaataattttttccatgactaaaaagtgtgtgttggtgtaaagaagaaagtggaagggacgt<br>tggtgatggtgagttcgtctatcccttnttatagttgcttgtatagtaggctactcttctagggactcgatgg<br>gggaaggttcttgatatttgcttagttcgagaaggttccagatgagcgagacattttggtacgacattgg<br>gtggatgatctgcacgacattttgtgattcttgcgacacgctgcactaccaagtgtagtctggctgaacg<br>gatcacaagataaacctctgaaaaattatctcagggcatgcaacaacaattatacatagaagaggagt<br>cacgatatacacctgtgaaggaatcatgtggtcggctctccttgaactttgaattcatgcaattattaagaa<br>gaagcacaggtgagcaacccaccatacgttcatttgcaccacctgatgattaaaagccaaagaaagaa<br>aaaaaaaaagaaacaggcggtgggaattgttacaaccccacgcgaacccgaaaatggagcaatcttc<br>ccgggggcctccaaataccaactcacccgagagagagagagacaccacccaccacgagacgg<br>agtatatccaccaaggtaagtaactcagggttaatgatacaggtgtacacagctccttccctagccattg<br>agtgggtatcacatgacactggcaggttacaaccacgtttagtagttattttgtgcaattccatggggatc<br>aggaagtttggtttggtgggtgcgtctactgattccccttgtctctgaaaatcttttccctagtggaacact<br>ttggctgaatgatataaattcaccttgattcccaccctcccttcttctctctctctgttacacccaattgaa<br>ttttctttnttttttttttactttccctcctttctttatcatcaaagataagtaagtttatcaattgcctattcaga |
| SEQ ID NO: 170 | pAA335 | ggtttgattggatcatcatgacgcctggtgtggggttggatgataaaggcgatgcgttgggccagcagt<br>ataggactgttgatgaggtggttctgactggtaccgatgtgattattgtcggggagagggttgtttggaaa<br>aggaagagaccctgaggtggagggaaagagatacagggatgctggatggaaggcatacttgaaga<br>gaactggtcagttagaataaatattgtaataaataggtctatatacatacactaagcttctaggacgtcatt<br>gtagtcttcgaagttgtctgctagtttagttctcatgatttcgaaaaccaataacgcaatggatgtagcagg<br>gatggtggttagtgcgttcctgacaaacccagagtacgccgcctcaaaccacgtcacattcgcccttg<br>cttcatccgcatcacttgcttgaaggtatccacgtacgagttgtaatacaccttgaagaacgtcgtct<br>acgcgcgagacgaaagggcctcgtgatacgcctatttttataggttaatgtcatgataataatggtttctta<br>gacgtcaggtggcacttttcggggaaatgtgcgcggaaccccctatttgtttatttttctaaatacattcaaa<br>tatgtatccgctcatgagacaataaccctgataaatgcttcaataatattgaaaaaggaagagtatgagta<br>ttcaacatttccgtgtcgcccttattccctttttttgcggcattttgccttcctgttttttgctcacccagaaacgc<br>tggtgaaagtaaaagatgctgaagatcagttgggtgcacgagtgggttacatcgaactggatctcaac<br>agcggtaagatccttgagagttttcgccccgaagaacgttttccaatgatgagcacttttaaagttctgct<br>atgtggcgcggtattatcccgtattgacgccgggcaagagcaactcggtcgccgcatacactattctca<br>gaatgacttggttgagtactcaccagtcacagaaaagcatcttacggatggcatgacagtaagagaatt<br>atgcagtgctgccataaccatgagtgataacactgcggccaacttacttctgacaacgatcggaggac<br>cgaaggagctaaccgcttttttgcacaacatgggggatcatgtaactcgccttgatcgttgggaaccgg<br>agctgaatgaagccataccaaacgacgagcgtgacaccacgatgcctgtagcaatggcaacaacgtt<br>gcgcaaactattaactggcgaactacttactctagcttcccggcaacaattaatagactggatggaggc<br>ggataaagttgcaggaccacttctgcgctcggcccttccggctggctggtttattgctgataaatctgga<br>gccggtgagcgtgggtctcgcggtatcattgcagcactggggccagatggtaagccctcccgtatcgt<br>agttatctacacgacggggagtcaggcaactatggatgaacgaaatagacagatcgctgagataggt<br>gcctcactgattaagcattggtaactgtcagaccaagtttactcatatatactttagattgatttaaaacttca<br>tttttaatttaaaaggatctaggtgaagatcctttttgataatctcatgaccaaaatcccttaacgtgagttttc<br>gttccactgagcgtcagaccccgtagaaaagatcaaaggatcttcttgagatcctttttttctgcgcgtaa<br>tctgctgcttgcaaacaaaaaaaccaccgctaccagcggtggtttgtttgccggatcaagagctaccaa<br>ctcttttccgaaggtaactggcttcagcagagcgcagataccaaatactgttcttctagtgtagccgtag<br>ttaggccaccacttcaagaactctgtagcaccgcctacatacctcgctctgctaatcctgttaccagtgg<br>ctgctgccagtggcgataagtcgtgtcttaccgggttggactcaagacgatagttaccggataaggcg<br>cagcggtcgggctgaacggggggttcgtgcacacagcccagcttggagcgaacgacctacaccga<br>actgagatacctacagcgtgagctatgagaaagcgccacgcttcccgaagggagaaaggcggaca<br>ggtatccggtaagcggcagggtcggaacaggagagcgcagggagcttccagggggaaacgc<br>ctggtatctttatagtcctgtcgggtttcgccacctctgacttgagcgtcgatttttgtgatgctcgtcaggg<br>gggcggagcctatggaaaaacgccagcaacgcggcctttttacggttcctggccttttgctggccttttg<br>ctcacatgttctttcctgcgttatcccctgattctgtggataaccgtattaccgcctttgagtgagctgatac<br>cgctcgccgcagccgaacgaccgagcgcagcgagtcagtgagcgaggaagcggaagagcgatgg<br>cagatcatcatgcctgcaggaagatgaagcgtatgagtattatgagtactgtcggacgttggaaggtgg<br>cagagttaagcccgagaaagcaaggaaggagtgggagatgatgagtgatgcggccaaagaggatg<br>tgaaggctgcgtatctgttttttgatagctggtggtagccgaatagaggaaggcaagcttgttcatattgg<br>atgatggtagatggtggctgccaaagtggttgtaaatagaaaaaagtgggtttgggtctgttgatag<br>ttagtggtggcggctgtctgtgattacgtcagcaagtagcacctcggcagttaaaacagcagcaacag<br>aaaaaaaatgtgtgaaagttgattccccacagtctaccacacccagagttccatttatccataatatca<br>caagcaatagaaaaataaaaaattatcaacaaatcacaacgaaaagattctgcaaaattattttcacttctt<br>cttttgacttcctcttcttcttgttaggttctttccatattttcccttaaaccatacacaacgcagccagaag<br>agcccgttctctagatgtgtgctcttccgctccaggcttgttatgactctagagagaagtgtgtgtgtgt<br>gtgcgtttgttttactatacattcaacatgttcttttttcttttttgatatttattccaactataattatacacagat<br>tcgtatatactttactttaccctctttcgtagttattaatttgatgattttttgagtttcatatccaaggtcaaaacc<br>cgaccgaattcatatgcgacgggtacaacgaagcttgatttgaattgatcaagaacatgatcttggtgtta<br>cagaacatcaagttcttggaccagactgagaatgcacagatatacaaggcgtcatgtgataaaatggat<br>gagatttatccacaattgaagaaagagtttatggaaagtggtcaaccagaagctaaacaggaagagc<br>aaacgaagaggtgaaacaagaagaagggtaaataagtatttgtattatataacaaacaaagtaag<br>gaatacagatttataccaataaattgccatactactcacgtgagatctcatccattccccaactcccaag<br>aaaaaaaaaagtgaaaaaaaaatcaaacccaaagtcaacctcccatcatcatcgtcatcaaacc<br>cccagctcaattcgcaatggttagcacaaaaacatacacagaaagggcatcagcacaccctccaag<br>gttgcccaacgttattccgcttaatggagtccaaaaagaccaacctctgcgcctcgatcgacgtgacc<br>acaaccgccgagttcctttcgctcatcgacaagctcggtccccacatctgtctcgtgaagacgcacatc<br>gatatcatctcagacttcagctacgagggcacgattgagccgttgcttgtgcttgcagagcgccacgg |

TABLE 40-continued

| SEQ ID NO: | Description | Sequence |
|---|---|---|
| | | gttcttgatattcgaggacaggaagtttgctgatatcggaaacaccgtgatgttgcagtacacctcgggg<br>gtataccggatcgcggcgtggagtgacatcacgaacgcgcacggagtgactgggaagggcgtcgtt<br>gaaggggttgaaacgcggtgcggagggggtagaaaaggaaaggggcgtgttgatgttggcggagtt<br>gtcgagtaaaggctcgttggcgcatggtgaatatacccgtgagacgatcgagattgcgaagagtgatc<br>gggagttcgtgattgggttcatcgcgcagcgggacatggggggtagagaagaag |
| SEQ ID NO: 172 | CvMIG1 | MLTPKDKKNKEDRPYKCTYCDKAFHRLEHQTRHIRTHTGEKPH<br>ACTFPGCVKRFSRSDELTRHLRIHTNPSSRKRKNKSQDLMGPTP<br>MSINGQNLPPGSYAVTNTGIPFAIDRNGNHVYPQPYPVFFVPQPN<br>GYMQPVVQAPGLSIVPPPPQQQQQQGQAPQQQQQQLHSQQQQ<br>QRMGSPHSNMTTPTHLQQEGSAVFSIPSSPTNSYQNVPNRPNQQ<br>PLPPPQPVTMSTPMSTRSMSSDAIRLPPLTSNNSFQQQQQQQPRP<br>PPTILKSESTTSKDSNRVFSQPNSNLHSLGTSPDTSPSAMPPPTVV<br>PTPSFSNLNEYFQQKSNNPRIFNASSSSLSSLSGKIRSTSSTNLAGL<br>QRLTPLVQTSTNSTPGKSIIPSQPSSTSLNLEFYNQGNASHASKKS<br>RPNSPCQSAMNISSIMSSPSETPLQTPSQSPRLHNGPGNSSVIEGA<br>QAKLESIATTGTQLPPIRSVLSFTNLSDYPPPPSNR |
| SEQ ID NO: 173 | ScMIG1-<br>Amino Acid | MQSPYPMTQVSNVDDGSLLKESKSKSKVAAKSEAPRPHACPICH<br>RAFHRLEHQTRHMRIHTGEKPHACDFPGCVKRFSRSDELTRHRR<br>IHTNSHPRGKRGRKKKVVGSPINSASSSATSIPDLNTANFSPPLPQ<br>QHLSPLIPIAIAPKENSSRSSTRKGRKTKFEIGESGGNDPYMVSSP<br>KTMAKIPVSVKPPPSLALNNMNYQTSSASTALSSLSNSHSGSRLK<br>LNALSSLQMMTPIASSAPRTVFIDGPEQKQLQQQQNSLSPRYSNT<br>VILPRPRSLTDFQGLNNANPNNNGSLRAQTQSSVQLKRPSSVLSL<br>NDLLVGQRNTNESDSDFTTGGEDEEDGLKDPSNSSIDNLEQDYL<br>QEQSRKKSKTSTPTTMLSRSTSGTNLHTLGYVMNQNHLHFSSSS<br>PDFQKELNNRLLNVQQQQEQHTLLQSQNTSNQSQNQNQNQM<br>MASSSSLSTTPLLLSPRVNMINTAISTQQTPISQSDSQVQELETLPP<br>IRSLPLPFPHMD |
| SEQ ID NO: 174 | ScMIG1-<br>Nucleotide | ATGCAAAGCCCATATCCAATGACACAAGTGTCTAACGTTGAT<br>GATGGGTCACTATTGAAGGAGAGTAAAAGCAAGTCCAAAGT<br>AGCTGCGAAGTCAGAGGCGCCAAGACCACATGCTTGTCCTAT<br>CTGTCATAGAGCTTTTCACAGACTGGAACATCAGACGAGACA<br>CATGAGAATTCATACAGGTGAGAAGCCTCACGCGTGTGACTT<br>CCCCGGATGTGTGAAAAGGTTCAGTAGAAGCGATGAACTGAC<br>GAGACACACAGAAGAATTCATACAAACTCCCACCCTCGAGGTAA<br>AAGAGGCAGAAAGAAGAAGGTTGTGGGCTCTCAATAAATA<br>GTGCTAGTTCTAGTGCTACCAGTATACCAGATTTAAATACGG<br>CAAATTTTTCACCGCCATTACCACAGCAACACCTATCGCCTTT<br>AATTCCTATTGCTATTGCTCCGAAAGAAAATTCAAGTCGATCT<br>TCTACAAGAAAAGGTAGAAAAACCAAATTCGAAATCGGCGA<br>AAGTGGTGGGAATGACCCATATATGGTTTCTTCTCCCAAAAC<br>GATGGCTAAGATTCCCGTCTCGGTGAAGCCTCCACCTTCTTTA<br>GCACTGAATAATATGAACTACCAAACTTCATCCGCTTCCACT<br>GCTTTGTCTTCGTTGAGCAATAGCCATAGTGGCAGTAGACTG<br>AAACTGAACGCGTTATCGTCCCTACAAATGATGACGCCCATT<br>GCTAGCAGTGCGCCAAGGACTGTTTTCATAGACGGTCCTGAA<br>CAGAAACAACTACAACAACAACAAAATTCTCTTTCACCACGT<br>TATTCCAACACTGTTATATTACCAAGGCCGCGATCTTTAACGG<br>ATTTTCAAGGATTGAACAATGCAAATCCAAACAACAATGGAA<br>GTCTCAGAGCACAAACTCAGAGTTCCGTACAGTTGAAGAGAC<br>CAAGTTCAGTTTTAAGTTTGAACGACTTGTTGGTTGGCCAAAG<br>AAATACCAACGAATCTGACTCTGATTTTACTACTGGTGGTGA<br>GGATGAAGAAGACGGACTAAAGGACCCGTCTAACTCTAGTAT<br>CGATAACCTTGAGCAAGACTATTTGCAAGAGCAATCAAGAAA<br>GAAATCTAAGACTTCCACGCCCACGACAATGCTAAGTAGATC<br>CACTAGTGGTACGAATTTGCACACTTTGGGGTATGTAATGAA<br>CCAAAATCACTTGCATTTCTCCTCATCATCTCCTGATTTCCAA<br>AAGGAGTTGAACAACAGATTACTGAACGTTCAACAACAGCA<br>GCAAGAGCAACATACCCTACTGCAATCACAAAATACGTCAAA<br>CCAAAGTCAAAATCAAATCAAATCAAATGATGGCTTCCAG<br>TAGTTCGTTAAGTACAACCCCGTTATTATTGTCACCAAGGGTG<br>AATATGATTAATACTGCTATATCCACCCAACAAACCCCCATTT<br>CTCAGTCGGATTCACAAGTTCAAGAACTGGAAACATTACCAC<br>CCATAAGAAGTTTACCGTTGCCCTTCCCACACATGGACTGA |
| SEQ ID NO: 175 | KlMIG1 | MTEAIIEKKNHKKSINDHDKDGPRPYVCPICQRGFHRLEHQTRHI<br>RTHTGERPHACDFPGCSKRFSRSDELTRHRRIHDSDKPKGKRGR<br>KKKSETIAREKELELQRQKQRNANDSAAVDSAGGTSANVIEPNH<br>KLLLKSTNSIKQDGSTFTEPLKSLRSKPMFDLGSDESDECGIYSVP<br>IRSQNNSGNIDLLLLNAAKFESDKASSSFKFIDKLPLTSSSSSPSLSF<br>TSHSINNSSSGLLLPRPASRAKLSALSSLQRMTPLSQNSESYNHSQ<br>QNLVHLHHPAPNRPLTEFVDNEYISNGLPRTRSWTNLSEQQSPS<br>GFSSSALNSRFSSSNLNQLIDQHSRNSSTVSISTLLKQETVISQDE<br>DMSTEDAYGRPLKKSKAIMPIMRPSSTMPPSSGSATEGEFYDEL |

TABLE 40-continued

| SEQ ID NO: | Description | Sequence |
|---|---|---|
| | | HSRLRSMDQLPVRNSKDEKDYYFQSHFSSLLCTPTHSPPPEGLLP<br>SLNQNKPVQLPSLRSLDLLPPK |
| SEQ ID NO: 176 | KlMIG1<br>(XP_454446) | ATGACAGAGGCGATTATAGAGAAAAAAAATCATAAGAAGTC<br>TATCAATGATCATGACAAGGATGGACCAAGGCCTTACGTCTG<br>TCCCATATGTCAAAGGGGATTCCATCGACTGGAACATCAGAC<br>TAGGCACATCAGAACACACACTGGGGAAAGACCGCATGCAT<br>GTGATTTCCCGGGATGTTCAAAACGCTTTAGTAGAAGCGATG<br>AACTAACAAGACATAGAAGGATACATGACAGTGATAAACCA<br>AAGGGGAAAAGAGGAAGGAAAAAGAAGAGTGAGACGATAG<br>CTCGTGAAAAGGAATTAGAATTGCAGCGGCAAAAACAACGA<br>AACGCAAACGACTCTGCGGCTGTTGATTCTGCTGGTGGAACG<br>AGCGCTAATGTCATAGAACCCAAACCACAAACTTCTGAAATCC<br>ACTAATTCGATTAAACAAGATGGTTCAACATTTACTGAACCT<br>CTGAAATCGTTGAGGTCGAAGCCAATGTTTGATCTCGGTAGC<br>GATGAATCGGATGAATGCGGTATATATAGTGTCCCACCTATT<br>AGATCTCAGAATAATAGTGGTAACATAGACCTTCTGCTGAAT<br>GCTGCAAAATTTGAGTCTGACAAAGCCTCATCCTCTTTCAAAT<br>TTATTGATAAACTACCGTTGACTTCATCTTCATCCTCTCCGTC<br>ACTTTCGTTTACATCTCATTCAATAACAACAGCAGTAGCGG<br>ACTATTGTTACCAAGACCAGCTTCACGTGCTAAGCTTTCTGCT<br>TTATCATCATTACAAAGAATGACACCCTTGTCTCAAAATTCAG<br>AGTCATATAATCATTCGCAACAGAATCTAGTACATCTTCACC<br>ATCCCGCACCCAACCGACCATTGACCGAGTTTGTTGATAACG<br>AGTATATAAGTAACGGTCTGCCTAGAACCAGATCGTGGACAA<br>ATCTGTCGGAACAGCAATCACCATCGGGCTTCAGCTCCTCTG<br>CACTTAACTCCAGATTCTCGTCATCCAATAGTCTCAACCAACT<br>GATAGATCAACATTCAAGAAATTCAAGTACTGTAAGCATATC<br>TACTCTACTGAAGCAAGAAACCGTAATCTCACAAGATGAGGA<br>TATGAGTACAGAAGATGCATATGGCCGGCCACTTAAGAAATC<br>AAAAGCCATAATGCCCATCATGAGACCTAGTTCTACAATGCC<br>ACCAAGTTCCGGCTCAGCTACAGAAGGAGAATTTTATGATGA<br>ACTTCATTCAAGGCTTAGATCGATGGATCAACTGCCGGTAAG<br>GAACAGTAAGGACGAAAAAGATTACTATTTCCAAAGTCATTT<br>TTCAAGTTTACTGTGCACTCCAACGCACAGTCCTCCACCGGA<br>AGGATTGTTACCCAGTTTGAATCAGAATAAGCCAGTGCAGTT<br>GCCATCACTTCGAAGCTTAGACCTTTTACCACCAAAATAA |
| SEQ ID NO: 177 | CtMIG1 | MNNQKMLSSKEKKNKEDRPYKCTYCDKAFHRLEHQTRHIRTHT<br>GEKPHACTFPGCVKRFSRSDELTRHLRIHTNPSSRKRKNKQDL<br>VEPTPMNVPPGSYAVPNTAIPFSIDRNGNHVYHQPYPVFFVPQPN<br>GYMQPVVQAPGLSIVPPPPHAHAQQAPQGGVPIQIQPPQPQRIAS<br>PHSNMSTPTHLQQEGSAVFSIPSSPTNSYQNAPNRQNLPQQPQPQ<br>PQITVQAVPMTTRSTSSDAIRLPPLTPNTTAQQPQPQRPQSAIFKS<br>ESNTSLYSDTSKVFSQPNSTLHSVGTSPDTSPSAMPPPIVVPAPSF<br>SNLNEYFQQKSNNPRIFNASSSSLSSLSGKIRSTSSTNLAGLQRLT<br>PLVPTTSTNTSNTTKSNIIPKQPSSTSLNLEFFNGNGTVGHANKKS<br>RPNSPCQSAMNISSIMSSPNETPLQTPSQSPRLNASNGPQSNIIEAA<br>QAKLESIATTGTQLPPIRSVLSFTNLSDYPQPTSN |
| SEQ ID NO: 178 | CtMIG1<br>(XP_002546501) | ATGAATAATCAAAAAATGTTATCTTCTAAGGAGAAAAAGAAT<br>AAGGAGGATAGACCTTACAAGTGTACTTATTGTGATAAAGCA<br>TTCCACAGATTGGAACATCAAACAAGACATATTAGAACCCAT<br>ACTGGTGAAAAACCTCATGCGTGTACTTTTCCTGGATGTGTTA<br>AAAGATTTAGTAGATCAGATGAACTAACAAGACATTTAAGAA<br>TTCATACTAATCCAAGTTCAAGAAAGAGAAAGAATAAGAATC<br>AAGATTTGGTTGAACCTACTCCAATGAATGTTCCTCCAGGTTC<br>ATATGCTGTTCCAAACACTGCAATTCCATTTTCTATTGATCGT<br>AATGGTAATCATGTCTACCATCAACCATATCCAGTATTTTTTG<br>TTCCTCAACCAAATGGTTATATGCAACCTGTTGTTCAAGCTCC<br>AGGCCTTTCTATTGTTCCACCACCACCTCATGCACATGCACAA<br>CAAGCACCACAAGGACCGGTTCCTATTCAAATTCAACCACCT<br>CAACCACAACGCATAGCAAGTCCACATAGTAATATGTCTACT<br>CCTACACATTTGCAACAAGAAGGTTCTGCTGTTTTCTCAATTC<br>CTTCATCTCCTACAAATTCATACCAAAATGCTCCAAATCGTCA<br>AAACCTACCACAACAACCACAACCACAGCCACAAATTACTGT<br>CCAAGCTGTTCCAATGACTACAAGATCAACATCATCAGATGC<br>TATTAGATTACCACCACTAACACCAAACACCACTGCCCAACA<br>ACCACAACCTCAACGTCCACAATCTGCCATTTTCAAATCAGA<br>ATCTAATACTAGCCTATACTCTGATACTAGTAAAGTATTTAGT<br>CAACCAAATTCTACTTTACATTCAGTAGGTACATCACCAGAT<br>ACAAGTCCTTCTGCAATGCCACCACCAATTGTTGTTCCTGCTC<br>CTTCTTTTAGTAATTTGAATGAATATTTTCAACAAAAGAGTAA<br>TAATCCAAGAATTTTCAATGCTAGTTCTTCATCTTTAAGTTCA<br>TTAAGTGGTAAGATTAGATCTACATCATCTACAAATCTTGCA<br>GGTTTACAAGATTGACTCCATTAGTTCCAACAACTAGTACA<br>AATACTTCTAACACTACAAAATCTAATATAATACCCAAACAG |

TABLE 40-continued

| SEQ ID NO: | Description | Sequence |
|---|---|---|
| | | CCTTCATCAACTTCATTAAATTTGGAATTTTTCAATGGTAATG<br>GAACTGTTGGACATGCAAATAAGAAATCAAGACCAAATTCAC<br>CATGTCAATCAGCAATGAATATTCTTCAATAATGAGTTCACC<br>AAATGAAACACCATTACAAACACCTTCACAATCACCACGTTT<br>GAATGCTAGTAATGGTCCTCAAAGTAACATCATTGAAGCTGC<br>TCAAGCTAAATTGGAAAGTATAGCTACTACAGGTACTCAATT<br>ACCACCAATTAGATCGGTTTTAAGTTTTACTAATTTGTCAGAT<br>TATCCACAACCCACGTCAAATTAG |
| SEQ ID NO: 179 | YlMIG1<br>(XP_503678) | MEFTATNSDREMHPPPVAVPSHLQQSTTHRTVPKTNPKTGKSE<br>MPRPYKCPICDKAFHRLEHQTRHIRTHTGEKPHECTFPGCTKRFS<br>RSDELTRHSRIHLNPNTRRAKNMNSAAAAAHNAAAQQKGPPSN<br>QQPKDDRTDRLVAISNLVDHHDAHPPIPGGSGIKSEYSSAYSTPY<br>SSVPSSPTMGQASLYRPYGAGPGGPPPPGGPGGLGGPAPPGPPG<br>HHGGPPTHIGLPPLHHPPPPGGPHSAAPSAPNSTPGSPMFVRVPH<br>STYPRSTFDMNMLATAASQQLERENAPPSGLSSGAPSAAPSGTSS<br>PFNHSPSSSPLQSTQSSPALASYFSRPPAPSSNPGTPGSSHGPPYGF<br>SSGTSLSSHGNTHSNHFQHPQHLHPPHHHHGLQGHIFAGLQRMT<br>PMSGRDDSEPWHRSKKSRPNSPSSTAPSSPTFSNSESPTPDHTPLA<br>TPAHSPRIHPRDLEGVQLPSIRSLSIGRHVPPTLPPMEIAPRSSGGT<br>HTGTHTPYGGGSASHTPFGTSPNSGVPPPHPNAAQGAASSLSML<br>AMAGLNHAAGGAAPGGSGAAATSSTRDEPSNDTSGPASGSGPS<br>APSTASSSTRMAVSDLIDR |
| SEQ ID NO: 180 | YlMIG1 | ATGGAATTCACAGCCACCAATTCAGACCGAGAAATGCACCCT<br>CCCCCGGTGGCAGTGCCGTCGCATCTGCAGCAGTCCACGACC<br>CACCGCACGGTGCCCAAAACCAACCCCAAGACGGGCAAGTC<br>CGAAATGCCCCGACCCTACAAGTGCCCCATCTGCGACAAGGC<br>CTTCCACCGGCTGGAGCATCAGACCCGCCACATCCGGACACA<br>CACGGGCGAGAAGCCCCACGAGTGCACCTTCCCAGGTTGCAC<br>CAAGCGGTTCAGCCGTAGCGACGAGCTCACCCGACACTCGCG<br>CATACATTTAAATCCCAACACTAGACGGGCAAGAACATGAA<br>CAGCGCCGCCGCCGCCGCTCACAATGCCGCCGCTCAGCAGAA<br>GGGCCCTCCTTCTAACCAGCAGCCCAAGGACGACCGAACAGA<br>CCGCCTTGTGGCCATCAGTAATCTCGTCGACCACCACGACGC<br>CCACCCTCCTATTCCCGGAGGCAGTGGTATCAAGAGCGAGTA<br>CTCGTCCGCATACTCGACTCCATATTCTTCGGTGCCGTCGTCG<br>CCAACCATGGGACAGGCCTCGTTGTACAGACCTTATGGTGCT<br>GGTCCAGGCGGTCCTCCTCCTCCTGGTGGACCTGGTGGACTG<br>GGTGGACCTGCTCCTCCTGGCCCTCCCGGCCACCATGGAGGA<br>CCCCCCACTCACATAGGTCTACCACCCCTACACCATCCTCCTC<br>CTCCAGGAGGCCCTCATTCGGCCGCGCCCAGTGCTCCCAACA<br>GTACGCCCGGGTCGCCCATGTTTGTGCGAGTGCCACATTCAA<br>CCTACCCAAGATCGACTTTCGACATGAACATGCTCGCGACTG<br>CGGCCTCTCAGCAGCTCGAGCGCGAGAACGCGCCTCCATCGG<br>GTCTGTCTTCTGGTGCTCCCTCGGCTGCGCCTTCCGGCACCTC<br>CAGCCCCTTCAACCATTCACCCTCGTCGTCGCCACTGCAGTCC<br>ACGCAGTCGTCCCCCGCTCTGGCGTCGTATTTCAGTCGGCCTC<br>CTGCTCCGTCTTCCAACCCCGGAACCCCCGGTAGCTCGCACG<br>GTCCTCCCTACGGCTTCTCGTCGGGCACGTCGCTGTCGTCGCA<br>TGGAAACACGCACTCCAATCACTTCCAGCACCCACAACACTT<br>GCATCCCCCGCATCATCACCATGGTCTGCAGGGACACATCTTT<br>GCGGGTCTGCAGCGCATGACGCCCATGTCTGGAAGAGACGAC<br>TCGGAGCCATGGCACCGGTCTAAGAAGTCGCGCCCAACTCA<br>CCGTCTTCTACTGCACCGTCGTCGCCCACTTTCAGCAACTCGG<br>AGAGCCCCACGCCGGACCACACGCCCCTGGCGACCCCCGCAC<br>ATTCGCCTCGAATCCACCCTCGAGATCTCGAGGGAGTGCAGC<br>TGCCTTCCATTCGGTCGCTGTCGATTGGCCGCCACGTGCCCCC<br>CACGCTACCGCCTATGGAGATTGCGCCTCGGTCAAGTGGAGG<br>CACCCATACCGGCACCCATACGCCGTACGGCGGCGGATCTGC<br>GTCGCACACGCCGTTTGGCACATCACCCAACTCGGGAGTTCC<br>TCCTCCGCATCCAAACGCGGCCCAGGGCGCTGCTTCTTCGCTT<br>AGCATGCTAGCCATGGCTGGCCTGAACCACGCTGCTGGGGGA<br>GCTGCTCCTGGAGGCAGTGGGGCGGCAGCTACGTCGTCGACG<br>CGCGACGAGCCCAGCAACGATACATCTGGGCCTGCGTCAGGC<br>AGCGGGCCTTCTGCTCCGTCCACCGCGTCGTCCAGTACTCGA<br>ATGGCCGTCAGTGACTTGATTGATAGATGA |
| SEQ ID NO: 181 | >CvCTF1 | MSSSDEGDHTPELQQEKVTQNTHSDAPSATPQTTPAQTTTTTTT<br>TTSSSQTTTTKKPKSDTKDKPKAFTIKYKRPRGSRACTVCRSRKV<br>RCDAEIHIPCTNCITFGCECILPEAKKRGNQSGESKAKRQKTQPK<br>DKAATTAASTKKKATTTTTTENGDEDGSPLEQTSSSRSAKSPDL<br>VTPTKESETSSHTSSTAEPIINISQVSVPPSLTSTYKNRPSMHKKEL<br>LDSKAKTALTFLGSSSIGVVPQRVGENHVELTTDVFDTSDIKLDS<br>VELEILKMRGAFLLPSKELSLELINAYFEHVHPLMPVINRSLFMK<br>KFNDPNDNPSLMVLHAVLLLGCRASKNPLLLDSNGTNDLASITF<br>FRRAKALYETNYESDPVSIIQTLILIGSYWDGPEDVTKNSFYWTR |

TABLE 40-continued

| SEQ ID NO: | Description | Sequence |
|---|---|---|
| | | VAVGLAQGFGFQRDVSKSHQLTVSEKKIWRRIWWCLFEKDRNV<br>AIAFGRPVVIDLNDCDVPMLTVDDFDETDPELGITDPYPVNETQ<br>ALYFIHLVKLAEITGIIIKHQYSVKSETMKRRNAFSIIEHCDMLMG<br>IWFTNLPSNLVFSLADSSTHNFFACLLNAQYYNRLYLIHRSNLIR<br>MARSSSTNPNNYKYPSWGISFQSARMISIISKILMDKDLIQFVPV<br>MYVYIAFSALVMLIYHVDSANSVIAATASDSLFVSRAVLRELQK<br>AWPVAAVLLKLFDKYANDKLKRTKLIENGNMIVEYKENAAKE<br>KMKKSINEYGTNTSPTAMPIPNRSPLSQPQQQPQQQQQHRQVVQ<br>QQLPLPQPAKPRDRTLFSPSSVTSGVSPGGNVYNNYSEQTPVKQ<br>EFSSVSPVAANPPQQQVQGSNPTPQIEELVKQYKLPMKRAAKAN<br>NGNGDSSDKQTTDTSPASSTKSFPDISMVTENLQNKQNFFENFEP<br>TQLFPTFSIPPTRAQSPTPNFDDGAIGSNVYNTMNTTMEIKEERTP<br>QPQQSGENQQEQPHNGNAAASLAAPAQTLKDEHDILDLHTPGF<br>QTNFIDSSFNYLNLQSGMNMDEDIHSLFNMMNQ |
| SEQ ID NO: 182 | CtCTF1<br>(XP_002546974) | MSDQKDGVAKLDQQKETENSHPETQTATTTTTTATQTTSTTSN<br>KKPKSDAKDKPKAFTIKYKRPRGSRACTVCRSRKVRCDAEIHIP<br>CTNCITFGCECILPEAKKRGNQSGESKAKRQKVNQSKDKPLSAT<br>ALKKKSSSNSTINTPINENGNSLEKSTSPVSNNKSSDMATTMSSN<br>NDTSENSNTTSTAEPIINISQVSVPPSLTSTYKNRPSMHKKELLDS<br>KAKTALTFLGSSSIGVVPQRAGENHVELTTDVFDTSDTKLDSVE<br>LEILKMRGAFLLPSKELSLELINAYFEHVHPLMPVINRSLFMKKF<br>NDPNDNPSLMVLHAVLLLGCRASKNPLLLDSKGTNDLASITFFR<br>RAKALYETNYESDPVSIIQTVILIGSYWDGPEDVTKNSFYWTRV<br>AVGLAQGFGFQRDVSKSHQLTISEKKIWRRIWWCLFEKDRNVAI<br>AFGRPVVIDLNDCDVPMLTVEDFDETDPELGIVDPYPINETQALY<br>FIHLVKLAEITGIIIKHQYSVKSETMKRRNAFSIIEHCDMLMGIWF<br>TNLPSKLVFSLADTSTHNFYACLLNAQYYNRLYLIHRSNLIRMA<br>RSSSTNPNNYKYPSWGISFQSARMISIISKILLDRNLIQYVPVMYV<br>YIAFSALVMLIYHVDSDNSVIAATAADSLYVSRAVLKELSKYWP<br>VAGVLLKLFDKYANDKLKRTRLIENGNMIVEYKENAAKEKMK<br>QSIGEYDSHSSSATMSIPNRQQQQQQASPLPQNRQSQQPLPLPQT<br>AKSKDHTMFSPTSATSGISPGGGVYNGYPDQTPIKRDFSSASSHP<br>HPQQQQQQQSGQLNQTQNNNQTPQIEELIRQYKLPMKRAAKGT<br>NGNNNVASDSSDKQTTETSPASSTKSFPDISMVTENLQNKQNFF<br>ENFEPTQLFPTFSIPPTRAQSPTPHFEDDGIGSNVYNSMNSTMML<br>KSDKQQKSQPSTEQQQQSQQLQQQQQPTHNGNSNQLVAGESHK<br>AEHDILDPNTPAFQTNFIDSSFNYLNLQSGMTMDDDIHSLFNMM<br>NQ |
| SEQ ID NO: 183 | CtCTF1 | ATGTCGGATCAAAAAGACGGGGTAGCTAAACTAGACCAACA<br>GAAGGAGACTGAAAATTCACACCCTGAAACTCAAACTGCAAC<br>AACAACGACAACAACAACAGCCACACAGACAACATCAACAA<br>CTTCAAATAAGAAACCAAAATCAGATGCAAAGGATAAACCA<br>AAAGCTTTCACTATAAAATATAAACGTCCTAGAGGTTCACGT<br>GCTTGTACCGTTTGTCGTTCAAGAAAAGTACGTTGTGATGCA<br>GAAATCCATATTCCTTGTACAAATTGCATTACTTTTGGTTGTG<br>AATGTATTTTACCAGAAGCAAAGAAAAGAGGCAATCAATCCG<br>GTGAATCAAAGGCAAAACGACAGAAAGTAAATCAATCAAAG<br>GATAAACCACTTTCGGCAACTGCCTTAAAAAAGAAATCCTCA<br>TCTAATTCTACAATAAACACACCAATAAATGAAAATGGCAAT<br>TCACTAGAGAAATCAACCTCTCCTGTATCGAACAACAAATCT<br>TCAGACATGGCGACAACAATGTCATCAAATAATGATACATCT<br>GAAAATTCAAATACTACGTCCACGGCGGAACCAATAATTAAT<br>ATATCACAAGTTAGTGTACCCCCTTCATTGACATCGACATATA<br>AAAACAGACCTTCTATGCATAAAAAGGAACTACTTGATTCAA<br>AAGCCAAAACTGCATTAACATTTTTGGGTCTGTCATCAATTGG<br>TGTTGTTCCTCAACGTGCAGGTGAAAATCATGTTGAATTAACT<br>ACCGATGTATTTGATACAAGTGATACTAAATTGGATTCTGTTG<br>AATTAGAAATTTTAAAAATGAGAGGTGCATTCTTATTACCAA<br>GCAAAGAATTATCCCTAGAATTGATTAATGCTTATTTTGAGCA<br>TGTTCATCCATTGATGCCAGTTATTAACCGATCGTTATTTATG<br>AAGAAATTTAATGATCCCAATGATAATCCAAGTTTAATGGTT<br>CTTCATGCCGTGTTGTTGTTGGGATTGTAGGGCATCTAAAAATC<br>CATTGTTGTTGGATTCCAAAGGTACCAACGATTTAGCCAGTAT<br>AACATTTTTCCGAAGAGCAAAAGCGTTATATGAAACAAATTA<br>TGAAAGTGATCCGGTATCAATTATTCAGACTGTAATTTTAATT<br>GGTTCCTATTGGGATGGTCCTGAGGATGTCACCAAGAATTCTT<br>TTTACTGGACTAGAGTTGCTGTGGGATTAGCTCAAGGGTTTG<br>GTTTTCAACGTGATGTTAGTAAATCACATCAATTGACTATTTC<br>AGAAAAGAAAATATGGAGAAGAATTTGGTGGTGTTTATTTGA<br>AAAGGATCGTAATGTAGCTATAGCATTTGGAAGACCAGTTGT<br>TATTGATTTAAATGATTGTGATGTACCAATGTTAACCGTGGAA<br>GATTTTGATGAAACTGATCCAGAATTGGGAATAGTTGACCCA<br>TATCCTATTAATGAAACCCAAGCCTTGTATTTTATTCATTTAG<br>TTAAATTGGCAGAAATAACTGGTATTATTATCAAACATCAAT<br>ATAGCGTAAAATCTGAAACCATGAAGAGAAGAAATGCATTTT |

TABLE 40-continued

| SEQ ID NO: | Description | Sequence |
|---|---|---|
| | | CCATTATTGAACATTGTGATATGTTGATGGGTATTTGGTTTAC<br>AAACTTACCCTCAAAATTGGTATTTTCATTGGCAGATACCCTG<br>ACTCATAATTTTTATGCCTGCTTATTAAATGCACAATATTATA<br>ATCGTTTATATTTGATTCATAGATCAAATTTGATTAGAATGGC<br>TAGATCATCATCAACAAACCCAAACAATTATAAATATCCAAG<br>TTGGGGTATTTCTTTCCAATCAGCAAGAATGATTTCTATAATT<br>TCAAAATATTATTGGATAGAAATTTGATTCAATATGTTCCAG<br>TCATGTACGTTTACATTGCATTTAGTGCATTGGTTATGTTGAT<br>TTATCATGTGGACTCGGATAATTCAGTTATTGCTGCCACTGCA<br>GCTGATTCGTTATATGTTTCAAGAGCAGTATTGAAAGAGCTTC<br>TGAAATATTGGCCAGTTGCAGGCGTGTTGTTGAAATTGTTTGA<br>TAAATATGCTAACGATAAATTGAAGAGAACAAGATTAATTGA<br>AAATGGTAATATGATTGTTGAATACAAGGAGAATGCAGCTAA<br>AGAAAAGATGAAACAATCTATTGGTGAATACGATAGTCATAG<br>CAGTTCCGCTACCATGTCGATTCCAAATAGACAACAACAACA<br>ACAACAGGCATCACCATTGCCACAGAATCGTCAGTCACAACA<br>ACCTTTACCGTTACCACAGACCGCAAAGAGTAAAGATCATAC<br>AATGTTTTCGCCAACGTCAGCAACTTCTGGAATATCGCCAGG<br>TGGAGGTGTTTACAATGGTTATCCAGATCAAACACCAATTAA<br>GAGAGATTTTTCACTGGCTTCATCACACCCACACCCACAACA<br>ACAACAACAACAGCAATCAGGTCAATTAAATCAAACTCAAA<br>ATAATAACCAAACACCACAGATTGAAGAATTAATAAGACAAT<br>ATAAATTACCAATGAAGCGTGCTGCAAAAGGTACTAATGGGA<br>ATAACAATGTTGCTAGTGATAGTAGTGATAAACAAACTACTG<br>AAACATCTCCTGCTTCATCTACAAAATCATTTCCAGATATATC<br>CATGGTTACTGAAAATTTACAAAATAAACAGAATTTCTTTGA<br>AAATTTCGAACCAACACAATTATTTCCTACATTCAGTATTCCA<br>CCAACAAGAGCACAATCCCCAACACCACATTTTGAAGATGAT<br>GGTATTGGTAGTAATGTTTATAATTCAATGAATTCAACCATGA<br>TGCTTAAATCAGACAAACAACAGAAAAGTCAACCATCCACAG<br>AACAGCAACAGCAACTGCAGCAACTTCAGCAGCAACAACAA<br>CCAACTCATAATGGGAATTCTAATCAACTTGTTGCAGGGGAA<br>TCACATAAAGCCGAACATGACATTCTTGATCCAAATACACCA<br>GCATTTCAAACTAATTTCATTGATAGTTCATTTAATTATTTGA<br>ATTTACAATCAGGAATGACTATGGATGATGATATTCATTCTTT<br>ATTTAATATGATGAATCAATAG |
| SEQ ID NO: 184 | Y1CTF1 (XP_502753) | MSSKVKEEEGATPGGSGNAKFGYRRAKPRASRACEVCHARKVR<br>CDVTERMPCTNCQAFGCECKIPEVKRKKNDKKAAAEKVADKG<br>TKDRKRRKTDGGEESDEGSVPPQAPSNASSSTASSPNTAPTAQQ<br>RLMHFQQETKQQQYQQHEGETKPDANPNLSDSSNTWLKMLDS<br>KVVKQSGRVAFLGSSSNLNLLLDANPDNEAYHYPLPAEITGGNP<br>VFHELDPEEIEILKLRGAFLLPPRELCDDIVESYFEKIHPVIPIVNRT<br>QFMRRYNDPVNTPSLLLLQAVLLAGSRVCRNPALLDANGSSDQ<br>ASLTFYKRAKALYDSNYENDRISIVQSLALMGWWWEGPEDVTK<br>NVFYWSRVGLCVAQFGLHRSYENSSLSVAEKRMWKRVWWVI<br>FFRDRAIAVSLGRPVMINLEDSDVPMLTEDDFIEDEPDYPSPYPV<br>NRLHSLYFIHAVKLSEIMGLVLRQQFSVGAEHSHRLNRIPVVSHC<br>DMAMGSWMNNLPPELKYSVKDMGSHNFYKALLHSQYYTILCL<br>VHRSNILQRRTSEANESAYPSWGIAFQAAHMIAKIMENMLAYNE<br>LRDTPAFMVYTLFSAMIMLVYQTESKSPSVVESANRSLDVCMK<br>ALEECGKTWVVARMVLKLFKHMNESQPIRNHMAKTIRRHARG<br>VSKPDAAKQQQMPQAQHQASQPPHGAQQHHAQQQRHAQQQQ<br>QQQQHARQQQQQQQQQQQHTQQQQQTHQPQPERKFNNHAF<br>DQQQQSQQEGEEYLGDRQPPTNPGTPFNGTLPSKPGTPHPDFYF<br>VTNTPPASNTFFESFQPMQLFPDVTGDMSNLQSQLQEPATSALPP<br>DMFAHADGASHTEGGTYKSSPEDEPTAASGFGYAPQSLNIGDW<br>YQYLMMNGEGGAAAGAAAGTAAGAGAPGSVPPGAPAEAHPEAAT<br>SNSWNESH |
| SEQ ID NO: 185 | Y1CTF1 | ATGTCTTCCAAGGTCAAAGAGGAGGAGGGCGCCACCCCGGG<br>CGGCTCAGGCAACGCCAAATTTGGCTATCGAAGGGCCAAGCC<br>GCGAGCTTCCAGGGCTTGTGAGGTGTGAGTGAGAGAGGAGG<br>GAAGATTGTCAGACGGACGGATAGGTGGAGCTGATCGCGAC<br>GAACCACTCAGTACTAACACAGATGCCATGCCCGAAAGTCC<br>GATGTGACGTTACAGAACGAATGCCGTGTACCGTGAGTATGG<br>TGGGGTGGAAGAAACAAACACTCCAGGAACAAAAGCGTTGT<br>CGACGTGTGAGTGACATGAGGCCATATCAACTAACATAGAAT<br>TGTCAAGCATTTGGATGCGAGTGCAAGATACCCGAAGTGAAG<br>CGGAAAAAGAACGACAAAAGGCGGCGGCAGAAAAGGTGG<br>CGGACAAGGGAACCAAGGACCGCAAACGACGCAAGACGGAC<br>GGCGGCGAGGAGTCCGACGAGGGCTCCGTGCCCCCCAGGC<br>GCCCTCCAACGCGTCTTCCTCCACAGCGTCGTCGCCCAACAC<br>GGCCCCCACTGCCCAGCAGCGGCTCATGCACTTTCAGCAGGA<br>GACCAAACAGCAACAGTACCAGCAACACGAGGGCGAGACGA<br>AACCGGACGCCAACCCCAACCTCAGCGACTCGTCCAACACGT<br>GGCTCAAAATGCTCGACTCCAAGGTGGTTAAACAGAGTGGCC |

TABLE 40-continued

| SEQ ID NO: | Description | Sequence |
|---|---|---|
| | | GGGTGGCGTTTCTGGGCTCCTCGTCCAACCTCAATCTGTTGTT<br>GGACGCTAACCCGGATAATGAAGCCTACCACTACCCCTTGCC<br>AGCCGAAATCACAGGTGGAAACCCCGTGTTCCATGAACTGGA<br>TCCCGAAGAGATTGAGATTCTCAAACTGAGAGGAGCCTTCCT<br>GTTACCTCCCCGAGAACTGTGTGACGACATTGTGGAGAGCTA<br>TTTTGAAAAGATCCACCCGGTCATCCCAATTGTCAACAGAAC<br>ACAGTTCATGCGCCGCTACAACGACCCCGTCAACACGCCGTC<br>GCTGCTGTTGCTTCAGGCCGTTCTGCTGGCTGGTTCTCGAGTG<br>TGCAGAAACCCGGCTCTACTGGACGCCAATGGGTCGTCAGAC<br>CAGGCGTCGCTCACCTTCTACAAGCGAGCCAAGGCACTGTAC<br>GACTCCAACTACGAAAATGATCGTATTTCAATTGTGCAGTCG<br>CTGGCCCTCATGGGCTGGTGGTGGGAGGGTCCCGAAGACGTG<br>ACCAAAAACGTCTTCTACTGGTCGCGTGTGGGTCTGTGTGTG<br>GCGCAAGGATTCGGTCTGCATCGATCTGTGGAAAACTCGTCG<br>CTGTCGGTGGCCGAAAAGCGAATGTGGAAGCGGGTGTGGTG<br>GGTCATCTTTTTCCGAGACCGAGCCATCGCCGTATCTTTGGGG<br>CGACCTGTTATGATCAACCTGGAAGACTCGGATGTGCCAATG<br>CTCACCGAAGACGATTTCATTGAGGACGAGCCTGACTACCCG<br>TCTCCCTACCCCGTCAACAGACTCCACTCGCTCTATTTTATTC<br>ACGCCGTCAAGCTGTCTGAAATCATGGGGCTTGTTCTGCGAC<br>AACAATTCAGTGTGGGTGCCGAGCACTCGCACCGACTAAACC<br>GAATTCCCGTCGTCTCGCACTGCGACATGGCCATGGGCTCGT<br>GGATGAACAACCTGCCGCCGGAGCTCAAGTACTCCGTCAAGG<br>ATATGGGCTCTCACAACTTCTACAAGGCCCTGCTCCACTCACA<br>ATACTACACGATTCTGTGTCTTGTGCACCGAAGCAACATTCTG<br>CAACGGCGAACGTCAGAGGCTAACGAGAGCGCATACCCTTCG<br>TGGGGTATCGCGTTCCAGGCCGCTCACATGATTGCCAAAATC<br>ATGGGAGAACATGTTAGCGTATAACGAGCTGCGTGACACCCCG<br>GCGTTCATGGTGTACACGCTCTTTTCGGCCATGATCATGCTTG<br>TGTACCAGACCGAGTCCAAGTCGCCGTCGGTGGTTGAGTCTG<br>CCAACCGGTCGCTGGACGTGTGTATGAAGGCCCTGGAGGAAT<br>GCGGCAAGACGTGGGTGGTGGCACGAATGGTGCTCAAGCTTT<br>TCAAGCACATGAACGAGTCGCAGCCCATTCGAAATCACATGG<br>CCAAGACCATCCGACGTCATGCTAGAGGCGTCAGCAAACCCG<br>ACGCAGCAAAGCAGCAGCAAATGCCTCAAGCTCAGCACCAG<br>GCTTCACAACCACCACATGGCGCCCAACAGCACCATGCCCAA<br>CAGCAACGACATGCCCAGCAACAACAACAACAGCAGCAGCA<br>TGCTCGACAGCAACAGCAGCAGCAGCAACAACAACAGC<br>AACACACACAACAGCAACAACAGACGCATCAGCACAGCCA<br>GAACGCAAGTTCAACAATCATGCGTTTGACCAGCAGCAGCAA<br>TCGCAGCAGGAAGGAGAGGAGTACCTGGGCGATAGACAGCC<br>TCCTACAAATCCCGGCACCCCTTTCAACGGCACGCTGCCATCC<br>AAGCCCGGCACCCCGCATCCGGACTTTTACTTTGTCACTAACA<br>CCCCGCCGGCTTCGAACACCTTCTTTGAGTCGTTCCAGCCCAT<br>GCAGCTTTTCCCCGACGTGACTGGCGATATGTCTAACCTGCA<br>GTCGCAGCTCCAGGAGCCCGCCACCAGCGCGCTTCCTCCGGA<br>CATGTTTGCCCACGCCGACGGAGCCAGCCACACCGAAGGCGG<br>CACCTACAAGTCGTCGCCCGAGGACGAGCCCACCGCGGCCAG<br>TGGATTTGGATACGCCCCTCAATCGCTCAATATTGGCGACTG<br>GTACCAATATCTGATGATGAACGGTGAAGGGGGTGCTGCTGC<br>TGGCGCTGCTGCTGGCACTGCTGCAGGCGCCCCTGGTTCTGTT<br>CCTCCAGGTGCTCCTGCTGAGGCTCATCCTGAAGCTGCCACTT<br>CCAACTCTTGGAATGAGTCTCACTAA |
| SEQ ID NO: 186 | K1UTR1<br>(XP_455838) | MVEGHPLEKVLSASALTSSSNSSSRSSIPLTFEVTHQHKTQIKRFQ<br>NVLTSDSATQDDGNDDPSRNQGNEVSEQFHLLQYPEQHQHQHQ<br>NKHQHQHQQQHEKGDLDEVLCTQRMFRKLSTGSDDVKKVYSH<br>AQLSSTAHGVRLLSKNLSNTKVALEVKKLMIVTKRQDDSLIYLT<br>RELVEWILVNYPTIDVYVEYGFERNESFNAKELCKDSKCGSHKI<br>QYWSPEFVKEHEDFFDLIITLGGDGTVLYVSSIFQKNVPPVMSFA<br>LGSLGFLTNFQFEDFKHALSKILQNKIKTKMRMRLCCQLFRKRIK<br>KVDEEARKTHIKYTMEGEYHVLNELTIDRGPSPFISMLELYGDG<br>SLLTVAQADGLIIASPTGSTAYSLSAGGSLVYPSVNAIAVTPICPH<br>TLSFRPIILPDSMTLKVKVPKASRSTAWAAFDGKNRVEMKRGDY<br>IVINASPYSFPTLEARSTEFIDSISRTLNWNVRESQKSFTHMLSRK<br>NQQKYEIHTVRTRQDSEEEELEDDQSDDYSTDSDSELNE |
| SEQ ID NO: 187 | K1UTR1 | ATGGTTGAAGGACACCCTTTGGAGAAGGTTCTGAGTGCTAGT<br>GCACTAACTTCAAGCAGTAACAGCTCATCAAGAAGTAGTATT<br>CCCTTGACATTTGAAGTCACTCATCAACACAAGACTCAGATC<br>AAGCGGTTCCAGAATGTGTTAACTAGTGATAGTGCCACCCAA<br>GATGACGGCAACGATGACCCTAGTAGAAATCAAGGGAATGA<br>GGTGAGTGAACAATTTCATTTGCTGCAGTATCCTGAGCAGCA<br>TCAACATCAACATCAAAATAAACATCAACATCAACATCAGCA<br>GCAGCACGAAAAGGAGATCTGGACGAGGTGCTCTGTACCC<br>AACGGATGTTCAGGAAACTATCTACTGGGAGCGATGATGTGA<br>AAAAGGTTTATTCGCATGCACAGCTATCGTCCACTGCACATG |

TABLE 40-continued

| SEQ ID NO: | Description | Sequence |
|---|---|---|
| | | GAGTGAGATTATTATCCAAAAATCTATCCAACACCAAAGTGG |
| | | CATTAGAAGTTAAGAAATTAATGATAGTAACTAAAAGGCAAG |
| | | ATGATTCTTTGATCTACTTGACAAGGGAGTTGGTAGAGTGGA |
| | | TCCTTGTCAATTATCCAACGATAGATGTTTATGTGGAATACGG |
| | | TTTTGAACGAAACGAATCTTTCAACGCAAAAGAGTTGTGTAA |
| | | AGACAGTAAATGTGGTTCGCATAAGATTCAATATTGGTCTCC |
| | | AGAATTTGTGAAAGAACACGAAGATTTCTTTGACCTAATCAT |
| | | AACACTTGGTGGAGATGGCACAGTATTATACGTATCATCAAT |
| | | TTTCCAAAAGAATGTGCCACCGGTCATGTCATTTGCCTTGGGG |
| | | TCTCTAGGATTCTTGACGAACTTCCAATTTGAAGACTTCAAAC |
| | | ATGCTTTGTCCAAGATTTTACAAAACAAGATTAAAACTAAGA |
| | | TGAGAATGCGACTATGTTGTCAACTTTTCAGGAAAAGGATCA |
| | | AGAAAGTGGACGAGGAAGCACGCAAGACGCATATTAAGTAC |
| | | ACAATGGAGGGAGAGTACCATGTTTTGAATGAACTTACGATT |
| | | GACAGAGGTCCTAGTCCGTTCATTTCAATGTTAGAATTATATG |
| | | GAGATGGATCTTTATTAACAGTGGCACAAGCAGACGGTCTGA |
| | | TCATAGCCTCGCCCACTGGATCCACAGCGTATTCCTTAAGTGC |
| | | TGGTGGTTCCTTGGTATACCCCAGCGTCAACGCTATTGCAGTT |
| | | ACACCAATCTGTCCTCATACTCTAAGTTTCAGACCCATCATCT |
| | | TGCCGGATAGTATGACGTTAAAAGTGAAAGTCCCAAAGGCTA |
| | | GCAGAAGCACCGCATGGGCAGCATTTGACGGTAAGAACAGA |
| | | GTGGAAATGAAGAGGGGCGACTACATAGTGATAAACGCAAG |
| | | TCCGTATTCATTCCCTACACTCGAAGCCCGCAGCACAGAATTT |
| | | ATTGACAGTATCAGTAGAACATTGAATTGGAACGTCAGGGAA |
| | | TCCCAAAAGTCGTTCACACATATGCTCTCAAGAAAGAATCAA |
| | | CAGAAGTACGAAATACACACCGTGAGAACCAGGCAGGATTC |
| | | TGAAGAAGAGGAAGAACTCGAAGACGACCAAAGTGATGATT |
| | | ATTCTACTGACTCTGACAGTGAACTGAACGAGTAA |
| SEQ ID NO: 188 | Y1UTR1 (XP_504486) | MSTPVSESPYVHQRFDAALSAASALQELSAEDIQSSRLSHAHFV |
| | | QTATGVRRIAKHLGKASVHIDVTKVMIITKARDNSLVYLTRDM |
| | | ARWLMDRGVVVYVDAKLEKSGRFDAPTLTANTPARMLRYWT |
| | | AEMATQKPELFDLVITLGGDGTVLWASWLFQGTAPPVIPFALGS |
| | | LGFLTNFEYHDFGKHLTKAMTQGVHVHLRMRFTCTVFKREMN |
| | | PETGKRDKHHSKIGRHEVLNEIVVDRGPSPFISMLELYGDDNLLT |
| | | IVQADGLILSTPTGSTAYSLSAGGSLVHPEIPAICVTPICPHTLSFR |
| | | PMLLPDSMTLKVVVPRKNSRTSAWVSFDGRSRVELKSGDYITV |
| | | RASKFPFPTVIRSDMDYIESVSRTLKWNTRELQKPLTSLSRPAST |
| | | VSVNRSASLHASSSVPSGAGYSRLRSRSMKGTPGVMTPISQLTA |
| | | ALPTIQQSTPSVPNTTNSNTPTSTGTANSNINNNYNPTTNPTTNTN |
| | | TNPTTTTTQKPYNLRDNQPSRSNSRDNGTASLPQSFSTSYMPNT |
| | | MPSGMTSTNSATPQQYSAASTTCLNSPPVTRGFTPIQQQSPAQIQ |
| | | AFESMIDFDIDDEGTSTFADCSRRGGLVMSPTSVFSPTGSNDGML |
| | | TLDDLGKQVSDSDSDSYHSSEYEEEEYDIDIDLAHKTENLHVLD |
| | | KDEDRNNEQEDTK |
| SEQ ID NO: 189 | Y1UTR1 | ATGAGCACTCCGGTCAGCGAGTCTCCGTACGTGCACCAGCGG |
| | | TTCGACGCTGCTCTCAGCGCCGCCTCGGCCCTCCAGGAGCTCT |
| | | CAGCTGAAGACATTCAGAGCTCACGACTCAGCCATGCTCACT |
| | | TCGTCCAAACTGCGACAGGAGTTCGACGAATTGCCAAACATC |
| | | TCGGCAAGGCCTCCGTCCACATCGATGTGACTAAGGTCATGA |
| | | TCATCACCAAGGCCCGAGACAACTCGCTTGTCTACCTGACCC |
| | | GAGATATGGCCCGGTGGTTGATGGACCGAGGAGTGGTGGTCT |
| | | ATGTGGATGCCAAACTCGAGAAGAGTGGCCGCTTCGACGCTC |
| | | CTACACTGACTGCAAACACCCCAGCACGTATGCTCAGATACT |
| | | GGACTGCCGAAATGGCGACCCAGAAGCCCGAGCTCTTTGATC |
| | | TAGTCATTACCCTGGGAGGAGACGGGACGGTTCTGTGGGCCT |
| | | CGTGGCTTTTTCAAGGCACCGCTCCCCCGTTATTCCCTTTGC |
| | | GCTGGGTTCGCTCGGCTTCCTGACCAATTTTGAATACCATGAC |
| | | TTTGGCAAGCATCTTACAAAGGCCATGACTCAGGGAGTACAT |
| | | GTGCATCTGAGAATGCGATTCACATGCACCGTGTTCAAGCGG |
| | | GAAATGAACCCGGAAACCGGAAAGAGAGATAAGCATCACTC |
| | | CAAGATTGGCCGACACGAAGTTCTCAACGAAATTGTCGTCGA |
| | | TAGAGGTCCTTCACCATTCATCTCAATGCTGGAGCTCTATGGG |
| | | GATGATAACCTGTTGACCATCGTACAGGCTGATGGCCTCATT |
| | | CTATCGACTCCCACAGGATCCACGGCATACTCTTTGTCAGCA |
| | | GGAGGCTCTCTGGTTCACCCTGAGATTCCAGCCATCTGTGTGA |
| | | CTCCAATTTGTCCCCATACCCTGTCCTTCAGACCCATGCTTCT |
| | | GCCTGATTCAATGACACTCAAGGTGGTTGTTCCTCGAAAGAA |
| | | CTCACGGACTTCAGCATGGGTCTCATTTGATGGCAGATCACG |
| | | TGTGGAGCTCAAGTCGGGCGACTACATCACAGTGCGAGCTTC |
| | | AAAGTTTCCATTCCCCACCGTGATCCGATCAGACATGGACTA |
| | | CATTGAGTCTGTGAGTCGAACACTCAAGTGGAACACCCGAGA |
| | | ACTCCAGAAGCCTCTGACGTCACTTTCCAGACCTGCATCGAC |
| | | CGTTTCTGTCAACAGAAGCGCCTCTCTCCATGCCTCTTCGTCA |
| | | GTGCCAAGTGGAGCAGGGTACAGCCGTCTGAGAAGTAGATC |
| | | GATGAAGGGCACCCCAGGAGTCATGACTCCCATCAGTCAGCT |

TABLE 40-continued

| SEQ ID NO: | Description | Sequence |
|---|---|---|
| | | TACTGCAGCACTGCCAACCATCCAGCAGAGCACTCCTTCCGT<br>TCCCAACACAACTAATAGTAACACACCTACAAGCACGGGTAC<br>TGCCAACTCCAACATCAACAACAATTACAACCCAACCACAAA<br>CCCAACCACAAACACGAACACAAACCCGACGACGACCACTA<br>CACAGAAACCCTACAATCTCAGAGACAACCAGCCCAGCAGA<br>AGCAACAGCAGAGATAACGGAACTGCTTCTCTTCCTCAAAGT<br>TTCAGCACAAGTTATATGCCCAACACAATGCCCAGCGGAATG<br>ACTAGCACTAACTCTGCCACTCCCCAGCAGTACTCGGCAGCC<br>TCTACTACATGTCTCAACTCACCCCCTGTTACCCGAGGCTTCA<br>CACCCATTCAGCAGCAGTCGCCGGCTCAGATCCAGGCGTTTG<br>AGAGTATGATTGACTTTGATATCGACGACGAAGGCACCTCCA<br>CCTTTGCCGACTGCTCTCGAAGAGGAGGACTGGTCATGTCCC<br>CGACATCTGTCTTCTCTCCCACCGGCTCCAACGACGGCATGCT<br>GACCTTGGACGATCTGGGTAAGCAGGTGTCGGACTCGGACTC<br>GGACTCGTACCACTCTTCGGAGTACGAGGAAGAGGAGTATGA<br>TATTGACATTGACCTTGCCCACAAGACGGAGAATTTGCATGT<br>GCTGGACAAGGACGAAGATAGGAACAACGAGCAGGAGGACA<br>CGAAGTAA |
| SEQ ID NO: 190 | CtUTR1 (XP_002547952) | MYATEEKKIEISDLRFLLQQAIEYSTAMNNNNNNNSSSSNSNYH<br>RAQFTTGSSTTTNSSTSSLSELTTSSSFQRKNNFVPHSPKIHSKLIC<br>DDVKAASGGNTPRSIKSHTELAETANGVRLLAKNLARATIQLDV<br>KAIMVITKARDNSLITLTKQLVEWLLESHPHIVVFVDSKLQQSKR<br>FGVAPCNSLKFWTKRLVKKQPELFDLVVTLGGDGTVLYASTLF<br>QHIAPPVLPFSLGSLGFLTNFQFQDFKRILNRCIESGVKANLRMRF<br>TCRVHSSDGKLIGQYQTLNELVVDRGPSPYVTQLELYGDSLLT<br>VAQADGLIIATPTGSTAYSLSAGGSLVHPGVSAISVTPICPHTLSF<br>RPVLLPDGMFLKVKVPDGSRATAWCSFDGKDRTELKKGDYVTI<br>QASSFPPPTVIASPTEYFDSVSRNLHWNVREQQKPLGNQTKDIDG<br>DMDNLHISSEQDEESEPDITEDDEEDDEFDINFTDTERSSYSSTPS<br>SDDIHYLSTNGAETPQSMSYLNNVDERCCFAHPNARVHLSGGKS |
| SEQ ID NO: 191 | CtUTR1 | ATGTATGCAACTGAAGAAAAAAAAATTGAAATCTCCGACCTA<br>CGGTTTCTTTTACAACAAGCTATTGAATACTCCACAGCAATGA<br>ATAACAACAACAACAATAATAGTAGTAGTAGTAATAGTAATT<br>ATCATAGAGCACAGTTTACTACTGGTTCTAGTACTACTACAA<br>ATTCATCAACTTCATCATTATCTGAACTTACAACTTCATCTTC<br>TTTTCAACGCAAGAATAATTTTGTCCCCCACTCTCCAAAAATC<br>CATTCCAAGTTGATTTGTGATGATGTTAAAGCTGCTCTGGGTG<br>GGAATACACCTCGTTCTATTAAATCACATACTGAATTGGCAG<br>AAAACAGCTAATGGTGTTAGATTACTTGCCAAAAACTTAGCTA<br>GAGCTACTATTCAACTTGATGTCAAAGCAATCATGGTTATTAC<br>TAAAGCAAGAGATAATAGTTTAATCACATTAACCAAACAATT<br>AGTTGAATGGCTTTTGGAAAGTCATCCACATATTGTTGTCTTT<br>GTTGATTCAAAGTTGCAACAATCAAAAAGATTTGGTGTTGCA<br>CCATGTAACTCATTAAAATTTTGGACTAAAAGATTGGTTAAA<br>AAACAACCTGAATTATTTGATTTGGTTGTTACATTAGGTGGTG<br>ATGGTACTGTTTTGTATGCTTCTACATTATTCCAACATATTGC<br>TCCTCCAGTTTTACCATTAGTCTTGGGTCTCTTGGTTTTTTGA<br>CAAATTTCCAATTCCAAGATTTCAAACGTATTTTGAATCGTTG<br>TATTGAATCAGGTGTCAAAGCAAATCTTCGTATGCGTTTCACT<br>TGTAGAGTTCATTCCAGTGATGGCAAATTAATTGGGCAATAT<br>CAAACATTGAATGAGTTGGTTGTCGATAGAGGTCCTTCTCCTT<br>ATGTTACTCAATTAGAATTGTATGGTGATGGTTCTTTGTTGAC<br>TGTTGCTCAAGCTGATGGGTTAATTATTGCTACTCCTACTGGT<br>TCAACTGCTTATTCATTATCAGCTGGTGGTTCATTGGTTCATC<br>CAGGTGTTAGTGCTATCAGTGTTACTCCAATTTGTCCACATAC<br>TTTATCATTTAGACCAGTTTTGTTACCTGATGGTATGTTTTTAA<br>AAGTCAAAGTTCCAGATGGTAGTAGAGCAACTGCTTGGTGTT<br>CATTTGATGGTAAAGATAGAACTGAGTTGAAAAAAGGTGATT<br>ATGTCACCATTCAAGCTTCATCATTCCCATTCCCAACAGTGAT<br>AGCATCACCAACTGAATATTTTGACTCTGTTAGTAGAAACTTG<br>CACTGGAATGTCAGAGAACAACAGAAACCATTAGGAAATCA<br>AACTAAAGATATTGATGGGGATATGGATAACTTGCATATTTC<br>AAGTGAACAGGATGAAGAAAGTGAACCGGACATTACTGAAG<br>ATGATGAAGAAGATGATGAATTTGATATTAATTTCACAGACA<br>CAGAACGTTCTTCATATAGTTCAACTCCATCTAGTGATGATAT<br>TCATTATCTTTCTACAAATGGGGCAGAAACCCCACAATCCAT<br>GTCTTATCTTAACAATGTTGATGAAAGATGTTGTTTTGCTCAT<br>CCTAATGCTAGAGTGCATTTAAGTGGAGGTAAGAGCTGA |
| SEQ ID NO: 192 | Promoter of SSA1 in pAA181 | ttttcttccgttctcgttccgtccttcaacccatatggatcgtgcgggaaaaatctgttttgcagcatgggcc<br>agtcgcatggaatccgatagaaagttagcaatcttgagattttatttctttagctgttttcggcccctttttgtgt<br>acccacgattatttttttcaacttctcttggttccatctcgttttgtcaacctcaattgaatggtcaattgaagctt<br>gttcatgtctgtagaagctcaatttgggtacaccatgtagtcacgatacctcgtcgcccagttgttctgccc<br>cttgcgcgaatgttccagcaggttctagcaagctctcattggggcattccagcaccttcgatggtgttcta<br>tgagcttcgatcgaaaaacacaaaacctatatgcaggactttttgcagctcctccccataaaactaaaatca |

TABLE 40-continued

| SEQ ID NO: | Description | Sequence |
|---|---|---|
| | | acctcccccttaagtttgctgtttcctcatgcctataaatatacgccaacctagcccgacttccagacttttt ttctaatccctttcttttgttttccttctaaatcaatcaattagatttattagactactatatcataataatcat cacataaaataacc |
| SEQ ID NO: 193 | Promoter of TEF1 in pAA332 | ctagcaaaggcttgatcagagaaagcaacaaaaaaaaaaactctaatactccagaatacactccttag aaacacacaacaaacaagcctagactaccatggactacgatgaagacgatttagattacatttctcaag gagaagaggaagagtttgacgaaaacaagttgaacaacgaagagtacgacttgttgcatgacatgctt ccggagttgaagacaaaattgaaagattacaatgatgagatcccagattacgatttaaaggaagcgtta tactacaactatttcgagatagaccctaccattgaagaattgaagacgaaattcaaaaagagtacgtata tacaactaacatcaacgcctttctagtttctgttctgtctccaatgcttctcctggtttcttcatggttctctctg taccaacaaggaaaaaaaaaaaatctggcaaaaaaaaccaaaccaaccaatgttcttactcaccaac gccctacaatc |
| SEQ ID NO: 194 | Terminator of TEF1 in pAA332 | tggaaatcgaactcgacggtcacaacacgctcccattaaccaagtacgaagacaacaagatactcgg aaggattgtcatcagaagagaaggggtgactatcggggctggtacggttgtcgattattcagaagattg atatatagtctattaacaacatcaataccaagtacgatgcatagagtaaccaacatgaggc |
| SEQ ID NO: 195 | CTF1 open reading frame | atgtcaagctcagatgaaggagatcacactcctgagttacaacaagagaaggttacccaaaatacccca ctcggacgcaccttctgcaacaccacaaacaaccccggctcagacaacaaccacaaccacaaccac cacttcctcctcccagacaaccactactaagaaaccaaaatcagatacaaaagataaaccaaaagcttt caccattaaatataaacgtcctagaggttcaagagcttgtaccgtctgtcgctcaagaaaagtccgttgt gacgcagaaatccacattccttgcacaaactgtataacattggctgtgaatgcatcttgccgaagcaa aaaagagaggcaatcaatcaggcgaatccaaagccaaacgacaaaagactcaaccaaaagacaaa gcagcaacaacagctgcttctaccaaaaagaaagcaacaactacaactacaaccgaaaacggcgat gaggatggctccccactagaacagacatcgtcgtctcgcagtgctaaatcccggacttggtaaccccc taccaaagaatcagaaacatccagtcacacatcatccacagcggagccaataataaatatatcacaagt gagtgttcctccgtctctttaacctcaactttataaaaacagaccatcaatgcacaaaaaggaacttctcgact cgaaagccaaaacagcattgacattcttggggctgtcgtcaatggtgttgttcctcaacgtgtcggggg agaaccacgtcgagttaaccactgacgttttgacaccagtgatatcaagttggattctgtcgaattgga gattttgaagatgagaggcgccttcttgttaccaagtaaagaactatcattggaattgatcaatgcgtattt tgaacacgtccacccattgatgcccgttataaatagatccttgtttatgaagaaattcaacgatccaaacg acaaccaagtttaatggttctccacgccgtgtactttgggctgtcgtgcctccaagaatccgttgttgt tggactcgaatggaacaaacgatttagcaagcattacatttttcagaagagccaaagcgttgtacgaga caaactacgaaagtgaccccgtgtcaattatccaaaccttgattttgattggctcgtattgggatggtccg gaggatgttaccaagaactccttctactggacaagagtggctgtggggttggcccaaggttttgggttc caacgtgatgtcagtaaatctcaccaattgacggtttctgaaaagaagatctggagaagaatctggtggt gtctatttgagaaagatcgtaatgtggctattcggtagaccagttgtgattgatttaaatgattgtga tgtcccatgttgaccgtggatgattttgacgaaactgacccagagttgggcatcaccgatccataccct gtaaacgaaactcaagcattatatttcatacatttggtgaagttggcagaaatcacaggtatcattatcaa acatcaatacagcgtcaagtctgaaaccatgaagagaaggaacgcgactccattatcgaacattgtga tatgttgatgggtatttggtttactaacttgccgtccaacttggtgttctcattggcggatagtctgacacac aacttcttttgcttgtttgctaaatgcacaatattacaaccgtttgtacttgatccacaggtccaatttgatcag aatggctagatcgtcatcaaccaaccccaaacaactacaagtaccccaagttggggtatttcttttccaatcg gccagaatgatttccatcatttccaaaatcttgatggacaaggattttgatacaattcgttcctgtcatgtatg tttacatcgcgttcagtgcattggttatgttaatctaccatgtggactcggccaactcagtcattgctgctac tgcttcagactccttgttttgtgtcaagagccgtcttgagggaacttcaaaaagcctggccagttgctgcg gtgctattgaaattgtttgacaagtatgctaacgacaagttgaagagaaccaagcttattgagaacggta acatgatcgtggagtacaaagagaatgctgctaaagaaaagatgaagaagtctattaatgaatatggca ccaacaccagtccaacagcaatgccaattccaaatagactgccattatcacaaccacagcaacaacca cagcaacaacaacaacaccgacaagttgttcaacagcaattgccgcttccgcagccggcaaaaccaa gagaccgtacgttgttctcgccaagttctgtcacatcaggggtttctccgggtggtaatgtttacaacaac tactcagagcagacaccggtcaaacaagagttttcgctggtttctcctgttgctgcaaacccacctcaac agcaagtacaaggtagcaaccctactccacagattgaagaattggttaaacaatacaagttgccaatga aacgtgctgctaaggcgaacaatgaaacggtgatagcagtgataaacaaaccaccgatacttctcca gcatcctccaccaagtcgttcccagatatctccatggttactgagaacttgcagaacaagcagaacttttt tgaaaactttgaaccaacacagttgttccctactttcagcatcccaccaactagagcgcagtctccaacg ccaaatttcgatgatggagctattggcagtaacgtgtacaataccatgaacaccaccatggagatcaaa gaagaaaggacaccacagccacaacaatcggggaaatcagcaggaacaacctcacaatggtaa tgctgctgcaagtcttgctgctccagcacaaacactcaaggacgaacacgacattcttgatctacatact ccaggattccaaaccaacttttattgatagctccttcaactacttgaacttgcaatcaggaatgaacatgga cgaggacattcattctttgtttaacatgatgaaccaatag |
| SEQ ID NO: 196 | Amplicon Fragment | gaattcggccggccacaagtgcacgtactgtgacaaggcattccacagattggagcaccagacaaga cacatacgaaccccacacgggcgaaaaacccccatgcctgcacctttcctgggtgtgtcaagcgcttcag caggtcagacgaactcacaagacacttgagaatccacaccaaccccatcgtcaagaaagagaaagaa caagagtcaggacttgatgggaccaactcctatgagcatcaatggccagaacttgcctccaggctcgt atgccgtgacaaacacgggtatccccttgctatcgaccgtaacgggccagaccggccggatccgca ttcgggccagaccggccggatccgcattcgggccagaccggccggatccgcattcgggccagacc ggccggatccgcattcgggccagaccggccggatccgcattcgggccagaccggccggccgcc aataccgtctcagccatcatctacatccttaaacctagagttctacaaccagggtaacgcttcccacgca agcaaaaaatcgcgaccaaactcccatgccagtccgccatgaacatctcgtccatcatgagctcacc aagcgaaaccccgctacagacgccatcacagtccccacgcttgcacgcaagcaacgggcctggtaa tagcagtgtcattgagggtgcacaggcaaagttggagagtatagcgacgacaggaacacagttgccg ccaattagatcggtgttgaggccggccgcatgc |

TABLE 40-continued

| SEQ ID NO: | Description | Sequence |
|---|---|---|
| SEQ ID NO: 197 | Sequence of the fragment in pAA1009 | gagctccaattgtaatatttcgggagaaatatcgttggggtaaaacaacagagagagagagggagag<br>atggttctggtagaattataatctggttgttgcaaatgctactgatcgactctggcaatgtctgtagctcgct<br>agttgtatgcaacttaggtgttatgcatacacacggttattcggttgaattgtggagtaaaaattgtctgag<br>ttgtgtcttagctactggctggccccccgcgaaagataatcaaaattacacttgtgaatttttgcacacac<br>accgattaacatttcccttttttgtccaccgatacacgcttgcctcttcttttttttctctgtgcttcccccctcct<br>gtgactttttccaccattgatataaaatcaactccatttccctaaaatctcccagattctaaaacaacttct<br>tctcttctgcttttccttattttgttatatttatttaccatcccttattttgaatagttattccccactaacattgt<br>tcaaatcttcacgacataatgtcccatcaagttgaagaccacgacttagacgtgttctgtttattggccgatg<br>ccgtgctccatgaaattcctcccagcgaaatcgtggagtaccttcatcctgacttcccaaaagataagat<br>cgaagagtatttgacaggcttttcccgtccgtctgctgttcctcagtttagacaatgtgccaagaagcttat<br>caacagaggctccgagctgtcgatcaagttgtttttgtacttgaccactgcgttggactcaagaatccttg<br>cacctgccttgaccaattcgttgactttgatcaggggatatggatattcccaaagagaggagttgttgaga<br>tcatggagagactctccttttaactgcaaaaagaagattatttagagtgtatgccttctttttaccttgtctactt<br>taacaagttgggaactgacttgcacttttaaggcgttgggctacccaggtagagagctcagaacgcaaa<br>ttcaagactacgaagtcgaccctttagatattcgtttatggagaaacttaaacacgagggccacgaatt<br>gttccttcctgatattgacgttttaatcatcgggtcgggatcaggagcaggtgtggttgcacaaactctta<br>ctgaaagtggcctcaaatcattggtttttggaaaaagggcaaatactttgccagtgaagaattgtgcatgac<br>ggacttggacggtaacgaggcattattcgaaagtggaggaacaattccttccaccaaccaacaattgtt<br>catgattgcaggttcgacttttggtggtggttctacagttaattggtctgcatgtttgaagaccccattcaaa<br>gtaagaaaggaatggtatgacgatttcggacttgattttgtcgctactcaacaatacgacgattgtatgga<br>ttacgtgtggaagaaaatgggtgcttcgaccgaacatctgctgcaaatgccgtcatcatg<br>gacggggcagcaaaacttggctacgcacacagagcacttgagcagaataccggggggccatgttcac<br>gactgtgggatgtgccacttgggatgtagattcggtatcaaacaaggtggtgtaaattgctggttccgtg<br>aacctagtgaaaagggttctaagttcatggaacaagttgttgttgaaaagattttgcagcacaagggtaa<br>agctactggatttgtgtagagatactgaaagtgggattaaattcaaaatcactggaccaaagaaatac<br>gttgtttccggtggttctcttgcaaaccccagttttgttacaaaaatctggttttcaagaataaacatattggag<br>ctaacttaaaacttcacccagtctcggttgcccttgggggacttttggtaatgaagtggactttgaagcntac<br>aagagaccacttatgaccgccgtttgtaatgccgtcgatgatttagatggcaaggcccatggaacaag<br>aattgaagccattttgcatgctccatacgtcactgccccatttttacccatggcaatcaggtgctcaagcaa<br>gaaagaacctcttgaaatataaacaaactgtgccgttattcttcttttctagagatacatcaggtaccg<br>ttacatatgataaaacaaaagcctgacgtattggtagttgactacactgttaacaagttgacagaaattcg<br>atttttacaaggggttttggttgcttccgacatcttgtatattgaaggtgctaaagagattttgtcaccacaag<br>cttgggtaccaaccttcaagagcaacaaaccaaaacatgctagatcgatcaaagacgaagattacgtc<br>aaatggagagaaaccgtggccaagatcccatttgactcctacggttcgccatacggttctgctcatcaa<br>atgagttcgtgtagaatgtctggtaagggaccaggatacggcttgtgacactaaaggaagattatttg<br>aatgtaacaacgtttacgttgctgatgcttcggttatgcctactgcatcgggagtcaatcctatgatcacta<br>caatggctttgcaagacatgtggccttatgtcttgctaaagacttgcaaccacaaactaaacttaggaa<br>tagaagaggtgactcttttgataagagtcgcaaatttgatttcataagtatatattcattatgtaaagtagt<br>aaatggaaaattcattaaaaaaaagcaaatttccgttgtatgcatactccgaacacaaaactagcccg<br>gaaaaaccccttagttgatagttgcgaatttaggtcgac |
| SEQ ID NO: 198 | MIG1 sequence ORF and flanking region | cggattatcttctgattattcttttttttttttttatagaaaaagcagtgagaaaattttttcctccagtatgtgg<br>gcaccaacaccaccacctgcacaaaagatgttcctcccccacttgatcttgtgggattctttgcttttttc<br>ggggagcagatatgtcagctggtggtgatccataggagctctcttgctcatgcttattaaaaaaaaga<br>cagcaaagccttcgacgaggtccatggttcctaatcggagtgtcaagcacgacgaacattgcccacca<br>gtaatattcctccaactctaagttaaaaaaaggccagttttttgttttccctatccggagttgcacaaacggttg<br>tacacatcgccaaactggataccacaggggcactacaatcttgttttcattgtttttgttgacccacgggtg<br>gtacttcgttgtatcgaatattttctggcacccatttttcttggggcgagatggagagagagacagagag<br>agaccaccatgaggctgatgcaggtgcccaggttgaacaagatgaaattcgctcggactgggttcc<br>gccccttccagaccgcttttctcagcacgatgatgtcgactgttgaaacggggggcgggcagggaaga<br>cagaaaacagaaattttcattaaattactgattgggttaattggcgggttagattctggagcttgaggagg<br>aagaggaggagaaggagaaggaggaagcctaaaaagttttttccgaaaattggaccagtttaaggcat<br>ccgacatatattacacaaagcaaggtgagtgcatgggaatataataatgcgtggttttgtgtagtttgttc<br>aagaaaagcgaacgagtgggcagaaattgcgggttacggtcgtttcttttttcctgggtgtgcttttgtcttt<br>ctggctgtaagaattgtcatataaattttaactccagatctctctttctctccccggtcccgtaagacaaaa<br>aaaaattgccctgtttccttctgcatcaccaaattcaccaccaccaccatgttaacccctaaggacaaga<br>agaacaaggaggacagaccatacaagtgcacgtactgtgacaaggcattccacagattggagcacc<br>agacaagacacatacgaacccacacgggcgaaaaaccccatgcctgcacctttcctggtgtgtcaa<br>gcgctcagcaggtcagacgaactcacaagacacttgagaattccacaccaacccatcgtcaagaaag<br>agaaagaacaagagtcaggacttgatgggaccaactcctatgagcatcaatggccagaacttgcctcc<br>aggctcgtatgccgtgacaaacacgggtatccccttttgctatcgaccgtaacggcaatcacgtgtaccc<br>tcaaccataccctgtgttttcgtcccacagccaaacggatacatgcagcctgttgttcaagcaccaggg<br>ctctccattgttccaccaccaccaccaccaacaaccaaggacaagcaccacaacaacagcagc<br>aacaacaactacattcacaacagcaacaacagcgtatgggtagcccacacagcaatatgacaacacc<br>tacacattgcaacaggaaggatcagcagttttctccattccttcgtccctacaaactcataccaaaatg<br>tcccaaaccgtccaaatcaacaaccattaccacctccacaaccagttaccatgtccacaccaatgtcta<br>cgagatcaatgtcgtcagatgctattagattgccaccactaacgtcaaacaactccttccaacaacaaca<br>acaacagcagccacgccaccaccaaccattctcaaatcggagtctacaactagcctatactcggatt<br>caaacagggtgtttagccaaccaaactcaaatttgcactcttttgggtacgtcgccagacacaagcccat<br>ccgccatgccaccaccaacagttgtcccaactccgtctttcagcaacttgaatgaatacttccagcaaaa<br>gagcaacaacccaaggattttcaacgccagttcatcatcctcgactcgttgagtggcaagatcagatc<br>cacgtcatccacaaaccttgcaggattgcaaagattgactccattggttcagacatctacaaactcgaca<br>cccggaaaatccataataccgtctcagccatcatctacatccttaaacctagagttctacaacaggta<br>acgcttcccacgcaagcaaaaatcgcgaccaaactccccatgccagtccgccatgaacatctcgtcc<br>atcatgagctcaccaagcgaaacccgctacagacgccatcacagtccccacgcttgcacgcaagca<br>acgggcctggtaatagcagtgtcattgagggtgcacaggcaaagttggagagtatagcgacgacag |

TABLE 40-continued

| SEQ ID NO: | Description | Sequence |
|---|---|---|
| | | gaacacagttgccgccaattagatcggtgttgagctttacaaaacttgtcggattatcctccgcctccttcta<br>atagatagatatacataattattagtaagagttgataaaaatacatacaaaaaaaccaactaagggatac<br>cgttatacatatactttcagtttcgtaacaatcagacgagtgtatatctggctggctatgtaattaacgcgg<br>gatgggagcattgtttctctccccgtgggcgaagtctgcttaaccccaggatctgcagcctgcaaac<br>ccagtgcaactccattgaacagagcctgcgaagcaaattttctcgaaacattttccagaccttggacttat<br>tccaccgagaaatgcaaccaacgaacaacgcaagtttcagtgtttccttttgtattttgcaggtgcatac<br>gcaagtgtgagtgaatgagtagtgtgatgggtttctgcttttgtggatttccaggttacgtcctggtattaat<br>tgttcttggggggttggtctcttttgggtagcttgttggtacaaggcgggttttttcattgcagcttcctttgg<br>attacaacgtgctttctccccacggaccgttgggcatggacggaaatataataacagccgggagaata<br>atacggaaggtgacgaagtaattatttcttcggattaaatttccctggaggttcaagagtgaattattat<br>catccatcgtcatcgccatcacttcctcttcctccccaacttcatctccagatcaatcccccacggattt<br>ttcacttctgattatttttaccacaaaacaataaccaggcttttctttcttttttttccattttttgaggagctgcc<br>cacaatggacccagtttacggccgcagaatcattcagtttcaaatacctggggaagacaagacaaagg<br>gaaggtgattagaacacatttgtgtgccgtacttgttcgccctacggggttgctgcaacgactttctctc<br>cgccctgcgaaaaactcccgtgctccctccccagaatcttactccgatgtttagactttttctcaacaact<br>ataaagggatcacgaatcctcagacactcttgtcattgctttcctagaccattatcaacttaccaaacaac<br>aaacatgtctactgctactgcttcccc |
| SEQ ID NO: 199 | CvUTR1 | atgtatgcgaccaacgaaaaaaaaattgaaatctccgacctacgatttcttttacaacaagcaatcgaat<br>actccacagccatgaataacaacaataatcatagctacaacaccaataacaactcccaccgagctgtat<br>tcacctctagcagctcaaccaccaactcatcgacctcctccttgtctgagctcaccacgtcatcgtctttc<br>caccgcaagaacaatatgatcccgcattctcccaaggtccactccaagttggtctgtgacgaaatctcc<br>gccgctctgactagtggaacaagcacgccgcgctccatcaagtctcacaccgagttggccgaaactg<br>ccaacggggtcagattgctcgccaagaacttgtcccgggccacgatccagctcgacgtgagagcaat<br>catggttatcaccaaggctagagacaacagcttgatcacattgaccaaacaactagtagagtggttgtt<br>ggaaactcaccctcacatcaccatctttgtcgacgccaaattgcagcaatctaagcgtttcggcgtagct<br>acttgcaactcgttgaagttctggaacaaaagattggttaaaaaacagccagagttgtttgacttggtcgt<br>cacgttgggcggtgatggtaccgtgttgtatgcgtctactttgttccagagcattgcaccaccggtcttgc<br>cattcagtcttgggtccctaggtttcttgacaaatttccagttccaggatttcaagcgcattttgaaccgctg<br>tatcgagtcaggtgttaaggcaaacctccgtatgcgttcacctgtagggttcatgccaacgacggcaa<br>gttgattggacagtaccagactttgaatgagcttgttgttgatagaggtccttctccttacgtcaccctgttg<br>gaattgtacggtgacggctcgttgttgacggttgctcaagcagacgggttgattatcgctactccaactg<br>ggtcgactgcttattcgttgtctgctggaggttctttagtgcatcctggtgttagtgctattagtgtcacccc<br>aatctgtccgcacaccctatcttttaggccaattttgttgcccgatgaatgttttgaaagtcaaagttcca<br>gacggtagtagagctactgcctggtgttgttcgatggtaaggacagaaccgaattgcacaagggtga<br>ttacgttaccatccaagcttcgccattcccattccctaccgtgatagcttctccaaacgaatactttgattct<br>gtcagtagaaacttgcattggaacgtcagagaacaacagaagccattgagtgataactccaaggatgtt<br>gatggggccatggacaacttgcacatttcgagtgaacaagacgaagaggacgaggaacctgagatta<br>ctgaagaggaggatgattttgatatcaatttcaccgatactgagcgttcttcctacagttctactccttcaa<br>gtgacgacatgaactttcttgcgggtaatggcacagctaccccacagaacatgtcttatcttaacaatgtt<br>gatgagagatgttgttttgcccaccctaatgctagagttcacttgagtggcggcaaaagc |
| SEQ ID NO: 200 | UTR1 (ATCC20962) sequence | atgtatgcgaccaacgaaaaaaaaattgaaatctccgacctacgatttcttttacaacaagcaatcgaat<br>actccacagccatgaataacaacaataatcatagctacaacaccaataacaactcccaccgagctgtat<br>tcacctctagcagctcaaccaccaactcatcgacctcctccttgtctgagctcaccacgtcatcgtctttc<br>caccgcaagaacaatatgatcccgcattctcccaaggtccactccaagttggtctgtgacgaaatctcc<br>gccgctctgactagtggaacaagcacgccgcgctccatcaagtctcacaccgagttggccgaaactg<br>ccaacggggtcagattgctcgccaagaacttgtcccgggccacgatccagctcgacgtgagagcaat<br>catggttatcaccaaggctagagacaacagcttgatcacattgaccaaacaactagtagagtggttgtt<br>ggaaactcaccctcacatcaccatctttgtcgacgccaaattgcagcaatctaagcgtttcggcgtagct<br>acttgcaactcgttgaagttctggaacaaaagattggttaaaaaacagccagagttgtttgacttggtcgt<br>cacgttgggcggtgatggtaccgtgttgtatgcgtctactttgttccagagcattgcaccaccggtcttgc<br>cattcagtcttgggtccctaggtttcttgacaaatttccagttccaggatttcaagcgcattttgaaccgctg<br>tatcgagtcaggtgttaaggcaaacctccgtatgcgttcacctgtagggttcatgccaacgacggcaa<br>gttgattggacagtaccagactttgaatgagcttgttgttgatagaggtccttctccttacgtcaccctgttg<br>gaattgtacggtgacggctcgttgttgacggttgctcaagcagacgggttgattatcgctactccaactg<br>ggtcgactgcttattcgttgtctgctggaggttctttagtgcatcctggtgttagtgctattagtgtcacccc<br>aatctgtccgcacaccctatcttttaggccaattttgttgcccgatgaatgttttgaaagtcaaagttcca<br>gacggtagtagagctactgcctggtgttgttcgatggtaaggacagaaccgaattgcacaagggtga<br>ttacgttaccatccaagcttcgccattcccattccctaccgtgatagcttctccaaacgaatactttgattct<br>gtcagtagaaacttgcattggaacgtcagagaacaacagaagccattgagtgataactccaaggatgtt<br>gatggggccatggacaacttgcacatttcgagtgaacaagacgaagaggacgaggaacctgagatta<br>ctgaagaggaggatgattttgatatcaatttcaccgatactgagcgttcttcctacagttctactccttcaa<br>gtgacgacatgaactttcttgcgggtaatggcacagctaccccacagaacatgtcttatcttaacaatgtt<br>gatgagagatgttgttttgcccaccctaatgctagagttcacttgagtggcggcaaaagc |
| SEQ ID NO: 201 | Promoter of SSA1 in pAA181 | ttttcttttcgttctcgttccgtccttcaacccatatggatcgtgcgggaaaaatctgattgcagcatgggcc<br>agtcgcatggaatccgatagaaagttagcaatcttgagattttatttcttttagctgtttcggccccttttgtgt<br>acccacgattatttttttcaactttcttggttccatctcgtttgtcaaacctcaattgaatggtcaattgaagctt<br>gttcatgtctgtagaagctcaattggggtacaccatgtagtcacgatacctcgtcgcccagttgttctgccc<br>cttgcgcgaatgttccagcaggttctgacaagctctcattggggcattccagcaccttcgatggtgttcta<br>tgagcttcgatcgaaaaacacaaacctatatgcaggacttttgcagctcctccccataaaactaaaatca<br>acctccccttaagtttgctgtttcctcatgcctataaatatacgccaacctagcccgacttccagactttt<br>tttctaatccctttcttttgttttccttctaaatcaatcaattgatttattagactactatatcataataatcat<br>cacataaaataacc |

TABLE 40-continued

| SEQ ID NO: | Description | Sequence |
|---|---|---|
| SEQ ID NO: 202 | Promoter of TEF1 in pAA332 | ctagcaaaggcttgatcagagaaagcaacaaaaaaaaaaactctaatactccagaatacactcctttag aaacacacaacaaacaagcctagactaccatggactacgatgaagacgatttagattacatttctcaag gagaagaggaagagtttgacgaaaacaagttgaacaacgaagagtacgacttgttgcatgacatgctt ccggagttgaagacaaaattgaaagattacaatgatgagatcccagattacgatttaaaggaagcgtta tactacaactatttcgagatagaccctaccattgaagaattgaagacgaaattcaaaaagagtacgtata tacaactaacatcaacgcctttctagtttctgttctgtctccaatgcttctcctggtttcttcatggttctctctg taccaacaaggaaaaaaaaaaaatctggcaaaaaaaaccaaaccaaccaatgttcttactcaccaac gccctacaatc |
| SEQ ID NO: 203 | Terminator of TEF1 in pAA332 | tggaaatcgaactcgacggtcacaacacgctcccattaaccaagtacgaagacaacaagatactcgg aaggattgtcatcagaagagaaggggtgactatcggggctggtacggttgtcgattattcagaagattg atatatagtctattaacaacatcaatataccaagtacgatgcatagagtaaccaacatgaggc |
| SEQ ID NO: 204 | CTF1 open reading frame | atgtcaagctcagatgaaggagatcacactcctgagttacaacaagagaaggttacccaaaatacccactcggacgcaccttctgcaacaccacaaacaaccccggctcagacaacaaccacaaccacaaccaccacttcctcctcccagacaaccactactaagaaaccaaaatcagatacaaaagataaaccaaaagctttcaccattaaatataaacgtcctagaggttcaagagcttgtaccgtctgtcgctcaagaaaagtccgttgtgacgcagaaatcccacattccttgcacaaactgtataacattttggctgtgaatgcatcttgcccgaagcaaaaaagagaggcaatcaatcaggcgaatccaaagccaaacgacaaaagactcaaccaaaagacaaagcagcaacaacagctgcttctaccaaaaagaaagcaacaactacaactacaaccgaaaacggcgatgaggatggctccccactagaacagacatcgtcgtctcgcagtgctaaatccccggacttggtaaccctaccaaagaatcagaaacatccagtcacacatcatccacagcggagccaataataaatatatcacaagtgagtgttcctccgtctttaacctcaacttataaaaacagaccatcaatgcacaaaaaggaacttctcgactcgaaagccaaaacagcattgacattcttggggctgtcgtcaataggtgttgttcctcaacgtgtcgggg agaaccacgtcgagttaaccactgacgtttttgacaccagtgatatcaagttggattctgtcgaattgga gattttgaagatgagaggcgcctcttgttaccaagtaaagaactatcattggaattgatcaatgcgtattttgaacacgtccacccattgatgccgttataaatagatccttgtttatgaagaaattcaacgatccaaacgacaacccaagtttaatggttctccacgccgtgctactttgggctgtcgtgcctccaagaatccgttgttgttggactcgaatggaacaaacgatttagcaagcattacattttcagaagagccaaagcgttgtacgagacaaactacgaaagtgacccccgtgtcaattatccaaaaccttgattttgattggctcgtattgggatggtccggaggatgttaccaagaactcctctctactggacaagagtggctgtggggttggcccaaggttttgggttccaacgtgatgtcagtaaatctcaccaattgacggtttctgaaaagaagatctggagaagaatctggtggtgtctatttgagaaagatcgtaatgtggctattgcattcggtagaccagttgtgattgatttaaatgattgtgatgtcccatgttgaccgtggatgattttgacgaaactgacccagagttgggcatcaccgatccatacccgtaaacgaaactcaagcattatatttcatacatttggtgaagttggcagaaatcacaggtatcattatcaacatcaatacagcgtcaagtctgaaaccatgaagagaaggaacgcgactccattatcgaacattgtatatgttgatgggtatttggtttactaacttgccgtccaacttggtgttctcattggcggatagtctgacacacaacttctttgcttgtttgctaaatgcacaatattacaaccgtttgtacttgatccacaggtccaatttgatcagaatggctagatcgtcatcaaccaacccaaacaactacaagtacccaagttggggtatttctttccaatcggccagaatgatttccatcattccaaaatcttgatggacaaggatttgatacaattcgttcctgtcatgtatgtttacatcgcgttcagtgcattggttatgttaatctaccatgtggactcggccaactcagtcattgctgctactgcttcagactccttgtttgtgtcaagagccgtcttgagggaacttcaaaaagcctggccagttgctgcggtgctattgaaattgtttgacaagtatgctaacgacaagttgaagagaaccaagcttattgagaacggtaacatgatcgtggagtacaaagagaatgctgctaaagaaaagatgaagaagtctattaatgaatatggcaccaacaccagtccaacagcaatgccaattccaaatagactgccattatcacaaccacagcaacaaccacagcaacaacaacaaccgacaagttgttcaacagcaattgccgcttccgcagccggcaaaaccaagagaccgtacgttgttctcgccaagttctgtcacatcaggggtttctccgggtggtaatgtttacaacaactactcagagcagacaccggtcaaacaagagttttcgctggtttctcctgttgctgcaaacccacctcaacagcaagtacaaggtagcaacccactccacagattgaagaattggttaaacaatacaagttgccaatgaacgtgctgctaaggcgaacaatggaaacgcgtgatagcagtgataaacaaaccaccgatacttctccagcatcctccaccaagtcgttcccagatatctccatggttactgagaacttgcagaacaagcagaacttttttgaaaactttgaaccaacacagttgttccctactttcagcatcccaccaactagagcgcagtctccaacgccaaatttcgatgatggagctattggcagtaacgtgtacaataccatgaacaccaccatggagatcaaagaagaaggacaccacagccacaacaatcggggaaaatcagcaggaacaacctcacaatggtaatgctgctgcaagtcttgctgctccagcacaaactcaaggacgaacacgacattcttgatctacatactccaggattccaaaccaacttttattgatagctccttcaactacttgaacttgcaatcaggaatgaacatggacgaggacattcattctttgtttaacatgatgaaccaatag |

Example 76: Description of Some Strains Referenced Herein

TABLE 41

Description of some strains referenced herein.

| Strain | Genetic Modifications |
|---|---|
| sAA496 | pox4Δ, CPR750, P450A19 |
| sAA617 | pox4Δ, CPR750, acoataΔ/ACOATB, POX5 |
| sAA620 | pox4Δ, CPR750, acoataΔ/ACOATB, POX5, ura3 |
| sAA632 | pox4Δ, CPR750, acoataΔ/ACOATB, P450A19 |
| sAA635 | pox4Δ, CPR750, acoataΔ/ACOATB, P450A19 |

TABLE 41-continued

Description of some strains referenced herein.

| Strain | Genetic Modifications |
|---|---|
| sAA722 | pox4Δ, acs1Δ/ACS1 |
| sAA741 | pox4Δ, acs1Δ/ACS1, ura3 |
| sAA776 | pox4Δ, acs1Δ |
| sAA779 | pox4Δ, acs1Δ, ura3 |
| sAA811 | pox4Δ, acs1Δ, P450A19 |
| sAA810 | pox4Δ, acs1Δ, P450A19, EcTESA |
| sAA865 | pox4Δ, acs1Δ, fat1Δ/FAT1 |
| sAA869 | pox4Δ, acs1Δ, fat1Δ/FAT1, ura3 |
| sAA875 | pox4Δ, acs1Δ, fat1Δ |

TABLE 41-continued

Description of some strains referenced herein.

| Strain | Genetic Modifications |
|---|---|
| sAA886 | pox4Δ, acs1Δ, fat1Δ, ura3 |
| sAA1764 | pox4Δ, acs1Δ, fat1Δ, eci1Δ/ECI1 |
| sAA1860 | pox4Δ, acs1Δ, fat1Δ, eci1Δ/ECI1, ura3 |
| sAA2058 | pox4Δ, pox5Δ, acs1Δ, fat1Δ, POX5(T287A) |
| sAA2109 | pox4Δ, pox5Δ, acs1Δ, fat1Δ, POX4(D96A) |
| sAA2220 | pox4Δ, acs1Δ, fat1Δ, eci1Δ |
| sAA2291 | pox4Δ, pox5Δ/POX5, acs1Δ, fat1Δ |
| sAA2310 | pox4Δ, pox5Δ/POX5, acs1Δ, fat1Δ, ura3 |
| sAA2399 | pox4Δ, pox5Δ, acs1Δ, fat1Δ |
| sAA2428 | pox4Δ, pox5Δ, acs1Δ, fat1Δ, ura3 |
| sAA2570 | pox4Δ, pox5Δ, acs1Δ, fat1Δ, POX5(F98G) |
| sAA2645 | pox4Δ, pox5Δ, acs1Δ, fat1Δ, POX5(S88A) |
| sAA2646 | pox4Δ, pox5Δ, acs1Δ, fat1Δ, POX5(G284E) |
| sAA2648 | pox4Δ, pox5Δ, acs1Δ, fat1Δ, POX5(S292A) |
| sAA2651 | pox4Δ, pox5Δ, acs1Δ, fat1Δ, POX5(P95A, Q96A) |
| **sAA2780 | pox4Δ, pox5Δ, acs1Δ, fat1Δ, POX4 |

Note:
Genes in lower case and/or with a Δ symbol indicate a deleted gene. Strains sAA617, sAA620 and sAA632 comprise a deletion of one allele of "acoat" and are heterozygous for the acoat gene knock out (e.g., acetoacetyl CoA thiolase$^{-/+}$).
**Strain AA2780 comprises a deletion of the endogenous POX4 gene (i.e., pox4Δ) and re-introduction of the wild type POX4 gene (i.e., POX4) under the control of a PEX11 promoter.

Example 77: Examples of Certain Non-Limiting Embodiments

A1. A genetically modified yeast, comprising:
one or more genetic modifications that substantially block beta oxidation activity;
one or more genetic modifications that increase one or more activities chosen from monooxygenase activity, monooxygenase reductase activity, thioesterase activity, acyltransferase activity, isocitrate dehydrogenase activity, glyceraldehyde-3-phosphate dehydrogenase activity, glucose-6-phosphate dehydrogenase activity, acyl-coA oxidase activity, fatty alcohol oxidase activity, acyl-CoA hydrolase activity, alcohol dehydrogenase activity, peroxisomal biogenesis factor activity, fatty aldehyde dehydrogenase activity, CTF, UTR, FAT1; and a genetic modification that decreases MIG1 activity.

A2. The genetically modified yeast of embodiment A1, wherein the one or more genetic modifications increase one or more monooxygase activities chosen from a CYP52A12 monooxygenase activity, CYP52A13 monooxygenase activity, CYP52A14 monooxygenase activity, CYP52A15 monooxygenase activity, CYP52A16 monooxygenase activity, CYP52A17 monooxygenase activity, CYP52A18 monooxygenase activity, CYP52A19 monooxygenase activity, CYP52A20 monooxygenase activity, CYP52D2 monooxygenase activity and BM3 monooxygenase activity.

A3. The genetically modified yeast of embodiment A1 or A2, wherein the one or more genetic modifications increase one or more monooxygenase reductase activities chosen from CPRA monooxygenase reductase activity, CPRB monooxygenase reductase activity and CPR750 monooxygenase reductase activity.

A4. The genetically modified yeast of any one of embodiments A1 to A3, wherein the one or more genetic modifications increase a IDP2 isocitrate dehydrogenase activity.

A5. The genetically modified yeast of any one of embodiments A1 to A4, wherein the one or more genetic modifications increase a GDP1 glyceraldehyde-3-phosphate dehydrogenase activity.

A6. The genetically modified yeast of any one of embodiments A1 to A5, wherein the one or more genetic modifications increase one or more glucose-6-phosphate dehydrogenase activities chosen from a ZWF1 glucose-6-phosphate dehydrogenase activity and ZWF2 glucose-6-phosphate dehydrogenase activity.

A7. The genetically modified yeast of any one of embodiments A1 to A6, wherein the one or more genetic modifications increase one or more fatty alcohol oxidase activities chosen from FAO1 fatty alcohol oxidase activity, FAO2A fatty alcohol oxidase activity, FAO2B fatty alcohol oxidase activity, FAO13 fatty alcohol oxidase activity, FAO17 fatty alcohol oxidase activity, FAO18 fatty alcohol oxidase activity and FAO20 fatty alcohol oxidase activity.

A8. The genetically modified yeast of any one of embodiments A1 to A7, wherein the one or more genetic modifications increase one or more alcohol dehydrogenase activities chosen from ADH1 alcohol dehydrogenase activity, ADH2 alcohol dehydrogenase activity, ADH3 alcohol dehydrogenase activity, ADH4 alcohol dehydrogenase activity, ADH5 alcohol dehydrogenase activity, ADH7 alcohol dehydrogenase activity, ADH8 alcohol dehydrogenase activity and SFA alcohol dehydrogenase activity.

A9. The genetically modified yeast of any one of embodiments A1 to A8, wherein the one or more genetic modifications increase one or more acyl-CoA hydrolase activities chosen from ACH-A acyl-CoA hydrolase activity and ACH-B acyl-CoA hydrolase activity.

A10. The genetically modified yeast of any one of embodiments A1 to A9, wherein the one or more genetic modifications increase one or more acyltransferase activities chosen from acyl-CoA sterol acyltransferase activity, diacylglycerol acyltransferase activity and phospholipid:diacylglycerol acyltransferase activity.

A11. The genetically modified yeast of embodiment A10, wherein the one or more acyltransferase activities are chosen from ARE1 acyl-CoA sterol acyltransferase activity, ARE2 acyl-CoA sterol acyltransferase activity, DGA1 diacylglycerol acyltransferase activity, and LRO1 phospholipid:diacylglycerol acyltransferase activity.

A12. The genetically modified yeast of any one of embodiments A1 to A11, wherein the one or more genetic modifications increase an acyl-coA thioesterase activity.

A13. The genetically modified yeast of embodiment A12, wherein the acyl-coA thioesterase activity is a TESA acyl-coA thioesterase activity.

A14. The genetically modified yeast of any one of embodiments A1 to A13, wherein the one or more genetic modifications increase a PEX11 peroxisomal biogenesis factor activity.

A15. The genetically modified yeast of any one of embodiments A1 to A14, wherein the one or more genetic modifications increase one or more fatty aldehyde dehydrogenase activities chosen from HFD1 fatty aldehyde dehydrogenase activity and HFD2 fatty aldehyde dehydrogenase activity.

A16. The genetically modified yeast of any one of embodiments A1 to A15, wherein the one or more genetic modifications increase a POX5 acyl-coA oxidase activity.

A17. The genetically modified yeast of any one of embodiments A1 to A16, wherein the one or more genetic modifications increase a monooxygenase activity and a monooxygenase reductase activity.

A18. The genetically modified yeast of embodiment A17, wherein the one or more genetic modifications increase a CYP52A19 monooxygenase activity and a CPRB monooxygenase reductase activity.

A19. The genetically modified yeast of embodiment A17, wherein the one or more genetic modifications increase a CYP52A14 monooxygenase activity and a CPRB monooxygenase reductase activity.

A20. The genetically modified yeast of any one of embodiments A1 to A19, wherein the one or more genetic modifications increase a monooxygenase activity, a monooxygenase reductase activity, and a isocitrate dehydrogenase activity.

A21. The genetically modified yeast of embodiment A20, wherein the one or more genetic modifications increase a CYP52A19 monooxygenase activity, a CPRB monooxygenase reductase activity, and a IDP2 isocitrate dehydrogenase activity.

A22. The genetically modified yeast of any one of embodiments A1 to A21, wherein the one or more genetic modifications increase a monooxygenase activity, a monooxygenase reductase activity, and a glucose-6-phosphate dehydrogenase activity.

A23. The genetically modified yeast of embodiment A22, wherein the one or more genetic modifications increase a CYP52A19 monooxygenase activity, a CPRB monooxygenase reductase activity, and a ZWF1 glucose-6-phosphate dehydrogenase activity.

A24. The genetically modified yeast of any one of embodiments A1 to A23, wherein a monooxygenase activity is by a polypeptide comprising an amino acid sequence chosen from SEQ ID NOs: 52, 53, 54, 55, 56, 57, 58, 59, 60 and 61.

A25. The genetically modified yeast of embodiment A24, wherein the polypeptide is encoded by a polynucleotide chosen from SEQ ID NOs: 14, 15, 16, 17, 18, 19, 20, 21, 22, 23 and 24.

A26. The genetically modified yeast of any one of embodiments A1 to A25, wherein a monooxygenase reductase activity is by a polypeptide comprising an amino acid sequence chosen from SEQ ID NOs: 28, 63, 64 and 65.

A27. The genetically modified yeast of embodiment A26, wherein the polypeptide is encoded by a polynucleotide chosen from SEQ ID NOs: 24, 25, 26 and 27.

A28. The genetically modified yeast of any one of embodiments A1 to A27, wherein a thioesterase activity is by a polypeptide comprising an amino acid sequence of SEQ ID NO: 38.

A29. The genetically modified yeast of embodiment A28, wherein the polypeptide is encoded by a polynucleotide of SEQ ID NO: 37.

A30. The genetically modified yeast of any one of embodiments A1 to A29, wherein an acyltransferase activity is by a polypeptide comprising an amino acid sequence chosen from SEQ ID NOs: 44, 46, 48 and 50.

A31. The genetically modified yeast of embodiment A30, wherein the polypeptide is encoded by a polynucleotide chosen from SEQ ID NOs: 43, 45, 47 and 49.

A32. The genetically modified yeast of any one of embodiments A1 to A31, wherein an isocitrate dehydrogenase activity is by a polypeptide comprising an amino acid sequence of SEQ ID NO: 67, 69 or 100.

A33. The genetically modified yeast of embodiment A32, wherein the polypeptide is encoded by a polynucleotide of SEQ ID NO: 68, 70 or 99.

A34. The genetically modified yeast of any one of embodiments A1 to A33, wherein a glyceraldehyde-3-phosphate dehydrogenase activity is by a polypeptide comprising an amino acid sequence of SEQ ID NO: 72.

A35. The genetically modified yeast of embodiment A34, wherein the polypeptide is encoded by a polynucleotide of SEQ ID NO: 71.

A36. The genetically modified yeast of any one of embodiments A1 to A35, wherein a glucose-6-phosphate dehydrogenase activity is by a polypeptide comprising an amino acid sequence of SEQ. ID NO: 74, 76 or 157.

A37. The genetically modified yeast of embodiment A36, wherein the polypeptide is encoded by a polynucleotide of SEQ ID NO: 73 or 75.

A38. The genetically modified yeast of any one of embodiments A1 to A37, wherein an acyl-coA oxidase activity is by a polypeptide comprising an amino acid sequence of SEQ ID NO:

A39. The genetically modified yeast of embodiment A38, wherein the polypeptide is encoded by a polynucleotide of SEQ ID NO: 31.

A40. The genetically modified yeast of any one of embodiments A1 to A39, wherein a fatty alcohol oxidase activity is by a polypeptide comprising an amino acid sequence chosen from SEQ ID NOs: 3, 5, 7, 9, 11, 13, 132 and 134.

A41. The genetically modified yeast of embodiment A40, wherein the polypeptide is encoded by a polynucleotide chosen from SEQ ID NOs: 2, 4, 6, 8, 10, 12, 131 and 133.

A42. The genetically modified yeast of any one of embodiments A1 to A41, wherein an acyl-CoA hydrolase activity is by a polypeptide comprising an amino acid sequence chosen from SEQ ID NOs: 34 and 36.

A43. The genetically modified yeast of embodiment A42, wherein the polypeptide is encoded by a polynucleotide chosen from SEQ ID NOs: 33 and 35.

A44. The genetically modified yeast of any one of embodiments A1 to A43, wherein an alcohol dehydrogenase activity is by a polypeptide comprising an amino acid sequence chosen from SEQ ID NOs: 129, 113, 115, 117, 119, 121, 123, 125, 127, 152 and 154.

A45. The genetically modified yeast of embodiment A44, wherein the polypeptide is encoded by a polynucleotide chosen from SEQ ID NOs: 130, 114, 116, 118, 120, 122, 124, 126, 128, 153 and 155.

A46. The genetically modified yeast of any one of embodiments A1 to A45, wherein a peroxisomal biogenesis factor activity is by a polypeptide comprising an amino acid sequence of SEQ ID NO: 96.

A47. The genetically modified yeast of embodiment 46, wherein the polypeptide is encoded by a polynucleotide of SEQ ID NO: 95.

A48. The genetically modified yeast of any one of embodiments A1 to A47, wherein a fatty aldehyde dehydrogenase activity is by a polypeptide comprising an amino acid sequence chosen from SEQ ID NOs: 139 and 141.

A49. The genetically modified yeast of embodiment 48, wherein the polypeptide is encoded by a polynucleotide chosen from SEQ ID NOs: 140 and 142.

A50. The genetically modified yeast of any one of embodiments A1 to A49 comprising one or more genetic modifications that decrease an acyl-coA synthetase activity.

A51. The genetically modified yeast of embodiment A50, wherein the one or more genetic modifications decrease one or more acyl-coA synthetase activities chosen from ACS1 acyl-coA synthetase activity and FAT1 long-chain acyl-CoA synthetase activity.

A52. The genetically modified yeast of embodiment A50 or A51, wherein the one or more genetic modifications disrupt a nucleic acid that encodes a polypeptide having the acyl-coA synthetase activity.

A53. The genetically modified yeast of any one of embodiments A50 to A52, wherein the acyl-coA synthetase activity is by a polypeptide comprising an amino acid sequence chosen from SEQ ID NOs: 40, 42, 80, 82, 84, 90, 158 and 159.

A54. The genetically modified yeast of embodiment A53, wherein the polypeptide is encoded by a polynucleotide chosen from SEQ ID NOs: 39, 41, 79, 81, 83 and 89.

A55. The genetically modified yeast of any one of embodiments A1 to A54, which is a *Candida* spp. yeast.

A56. The genetically modified yeast of embodiment A55, wherein the *Candida* spp. yeast is chosen from *C. tropicalis* and *C. viswanathii*.

A57. The genetically modified yeast of embodiment A56, wherein the *Candida* spp. yeast is a genetically modified ATCC20336 yeast.

A58. The genetically modified yeast of any one of embodiments A1 to A57, which is chosen from a *Yarrowia* spp. yeast, *Pichia* spp. yeast, *Saccharomyces* spp. yeast and *Kluyveromyces* spp. yeast.

A59. The genetically modified yeast of embodiment A58, which is chosen from *Y. lipolytica, P. pastoris, P. membranifaciens, P. kluyveri, P. guilliermondii, P. heedii, P. subpelliculosa, S. cerevisiae, S. bayanus, S. pastorianus, S. carlsbergensis, K. lactis* and *K. marxianus*.

A60. The genetically modified yeast of any one of embodiments A1 to A59, which is capable of producing a diacid from a feedstock comprising one or more components from a vegetable oil.

A61. The genetically modified yeast of embodiment A60, wherein the diacid is a C4 to C24 diacid.

A62. The genetically modified yeast of embodiment A61, wherein the diacid is a C10, C12, C14, C16, C18 or C20 diacid.

A62.1. The genetically modified yeast of embodiment A62, wherein the diacid is a C10 diacid.

A63. The genetically modified yeast of embodiment A62, wherein the diacid is a C12 diacid.

A64. The genetically modified yeast of embodiment A62, wherein the diacid is a C18 diacid.

A65. The genetically modified yeast of any one of embodiments A60 to A64, wherein the diacid contains no unsaturation.

A66. The genetically modified yeast of any one of embodiments A60 to A64, wherein the diacid contains one or more unsaturations.

A67. The genetically modified yeast of any one of embodiments A60 to A66, wherein the diacid is the predominant diacid in a mixture of diacids.

A68. The genetically modified yeast of any one of embodiments A60 to A67, wherein the feedstock comprises a substantially pure oil.

A69. The genetically modified yeast of any one of embodiments A60 to A68, wherein the feedstock comprises a plurality of fatty acids.

A70. The genetically modified yeast of embodiment A69, wherein the feedstock comprises a soapstock.

A71. The genetically modified yeast of embodiment A69, wherein the feedstock comprises a fatty acid distillate.

A72. The genetically modified yeast of any one of embodiments A60 to A71, wherein the vegetable oil is from a plant chosen from palm, palm kernel, coconut, soy, safflower, canola or combination thereof.

A73. The genetically modified yeast of any one of embodiments A1 to A73, wherein a genetic modification that increases an activity comprises incorporating in the yeast multiple copies of a polynucleotide that encodes a polypeptide having the activity.

A74. The genetically modified yeast of any one of embodiments A1 to A73, wherein a genetic modification that increases an activity comprises incorporating in the yeast a promoter in operable linkage with a polynucleotide that encodes a polypeptide having the activity.

A75. The genetically modified yeast of embodiment A74, wherein the promoter is native to the yeast.

A76. The genetically modified yeast of embodiment A74 or A75, wherein the promoter is chosen from a POX4 promoter, PEX11 promoter, TEF1 promoter, PGK promoter and FAO1 promoter.

A77. The genetically modified yeast of embodiment A76, wherein the promoter comprises a polynucleotide chosen from SEQ ID NOs: 162, 165, 166, 167 and 169.

B1. A method for producing a diacid, comprising:
contacting a genetically modified yeast of any one of embodiments A1 to A77 with a feedstock capable of being converted by the yeast to a diacid; and
culturing the yeast under conditions in which the diacid is produced from the feedstock.

B2. The method of embodiment B1, wherein the feedstock comprises one or more components from a vegetable oil.

B3. The method of embodiment B1 or B2, wherein the diacid is a C4 to C24 diacid.

B4. The method of embodiment B3, wherein the diacid is a C10, C12, C14, C16, C18 or C20 diacid.

B5. The method of embodiment B4, wherein the diacid is a C10 diacid.

B6. The method of embodiment B4, wherein the diacid is a C12 diacid.

B7. The method of embodiment B4, wherein the diacid is a C18 diacid.

B8. The method of any one of embodiments B1 to B7, wherein the diacid contains no unsaturation.

B9. The method of any one of embodiments B1 to B7, wherein the diacid contains one or more unsaturations.

B10. The method of any one of embodiments B1 to B9, wherein the diacid is the predominant diacid in a mixture of diacids.

B11. The method of any one of embodiments B1 to B10, wherein the feedstock comprises a substantially pure oil.

B12. The method of any one of embodiments B1 to B10, wherein the feedstock comprises a plurality of fatty acids.

B13. The method of embodiment B12, wherein the feedstock comprises a soapstock.

B14. The method of embodiment B12, wherein the feedstock comprises a fatty acid distillate.

B15. The method of any one of embodiments B1 to B14, wherein the vegetable oil is from a plant chosen from palm, palm kernel, coconut, soy, safflower, canola or combination thereof.

B16. The method of any one of embodiments B1 to B8 wherein the feedstock comprises a fatty acid methyl ester.

B17. The method of embodiment B16 wherein the fatty acid methyl ester is methyl laurate and the diacid comprises dodecanedioic acid.

B18. The method of any one of embodiments B1 to B8 wherein the feedstock comprises a fatty acid ethyl ester and the diacid comprises dodecanedioic acid.

B19. The method of any of embodiments B1 to B8 wherein the feedstock comprises lauric acid and the diacid comprises dodecanedioic acid.

B20. The method of any of embodiments B1 to B8 wherein the feedstock comprises ethyl caprate and the diacid comprises sebacic acid.

C1. A method for producing a diacid by a yeast from a feedstock toxic to the yeast, comprising:
(a) contacting a genetically modified yeast in culture with a feedstock not substantially toxic to the yeast, thereby performing an induction; and
(b) contacting the yeast after the induction in (a) with a feedstock toxic to the yeast,
whereby a diacid is produced by the yeast from the feedstock toxic to the yeast in an amount greater than the amount of the diacid produced from the feedstock toxic to the yeast when the induction is not performed.

C2. The method of embodiment C1, wherein the feedstock not substantially toxic to the yeast has the same number of carbons as the feedstock toxic to the yeast.

C3. The method of embodiment C1, wherein the feedstock not substantially toxic to the yeast has a different number of carbons compared to the feedstock toxic to the yeast.

C4. The method of any one of embodiments C1 to C3, wherein the feedstock not substantially toxic to the yeast comprises a fatty acid methyl ester.

C5. The method of any one of embodiments C1 to C3, wherein the feedstock not substantially toxic to the yeast comprises a free fatty acid.

C6. The method of any one of embodiments C1 to C5, wherein the feedstock not substantially toxic to the yeast comprises more than twelve carbons.

D1. An isolated nucleic acid comprising a polynucleotide that encodes a polypeptide of SEQ ID NO: 148 or 150.

D2. The isolated nucleic acid of embodiment D1, wherein the polynucleotide comprises the nucleotide sequence of SEQ ID NO: 147 or 149.

D3. An isolated nucleic acid, comprising a polynucleotide that comprises: the nucleotide sequence of SEQ ID NO: 37 or a nucleotide sequence having greater than 75% identity to SEQ ID NO: 37.

D4. An isolated nucleic acid comprising a polynucleotide that encodes: the polypeptide of SEQ ID NO: 44; a polypeptide comprising an amino acid sequence having greater than 71% identity to SEQ ID NO: 44; or a polypeptide of SEQ ID NO: 44 having 1 to 5 amino acid substitutions.

D5. The isolated nucleic acid of embodiment D4, wherein the polynucleotide comprises the nucleotide sequence of SEQ ID NO: 43 or a nucleotide sequence having greater than 69% identity to SEQ ID NO: 43.

D6. An isolated nucleic acid comprising a polynucleotide that encodes: the polypeptide of SEQ ID NO: 46; a polypeptide comprising an amino acid sequence having greater than 71% identity to SEQ ID NO: 46; or a polypeptide of SEQ ID NO: 46 having 1 to 5 amino acid substitutions.

D7. The isolated nucleic acid of embodiment D6, wherein the polynucleotide comprises the nucleotide sequence of SEQ ID NO: 45 or a nucleotide sequence having greater than 70% identity to SEQ ID NO: 45.

D8. An isolated nucleic acid comprising a polynucleotide that encodes: the polypeptide of SEQ ID NO: 48; a polypeptide comprising an amino acid sequence having greater than 87% identity to SEQ ID NO: 48; or a polypeptide of SEQ ID NO: 48 having 1 to 5 amino acid substitutions.

D9. The isolated nucleic acid of embodiment D8, wherein the polynucleotide comprises the nucleotide sequence of SEQ ID NO: 47 or a nucleotide sequence having greater than 78% identity to SEQ ID NO: 47.

D10. An isolated nucleic acid comprising a polynucleotide that encodes: the polypeptide of SEQ ID NO: 50; a polypeptide comprising an amino acid sequence having greater than 80% identity to SEQ ID NO: 50; or a polypeptide of SEQ ID NO: 50 having 1 to 5 amino acid substitutions.

D11. The isolated nucleic acid of embodiment D10, wherein the polynucleotide comprises the nucleotide sequence of SEQ ID NO: 49 or a nucleotide sequence having greater than 75% identity to SEQ ID NO: 49.

D12. An isolated nucleic acid comprising a polynucleotide that encodes: the polypeptide of SEQ ID NO: 67; a polypeptide comprising an amino acid sequence having greater than 99% identity to SEQ ID NO: 67; or a polypeptide of SEQ ID NO: 67 having 1 to 5 amino acid substitutions.

D13. The isolated nucleic acid of embodiment D12, wherein the polynucleotide comprises the nucleotide sequence of SEQ ID NO: 68 or a nucleotide sequence having greater than 97% identity to SEQ ID NO: 68.

D14. An isolated nucleic acid comprising a polynucleotide that encodes: the polypeptide of SEQ ID NO: 74; a polypeptide comprising an amino acid sequence having greater than 99% identity to SEQ ID NO: 74; or a polypeptide of SEQ ID NO: 74 having 1 to 5 amino acid substitutions.

D15. The isolated nucleic acid of embodiment D14, wherein the polynucleotide comprises the nucleotide sequence of SEQ ID NO: 73 or a nucleotide sequence having greater than 97% identity to SEQ ID NO: 73.

D16. An isolated nucleic acid comprising a polynucleotide that encodes: the polypeptide of SEQ ID NO: 76; a polypeptide comprising an amino acid sequence having greater than 99% identity to SEQ ID NO: 76; or a polypeptide of SEQ ID NO: 76 having 1 to 5 amino acid substitutions.

D17. The isolated nucleic acid of embodiment D16, wherein the polynucleotide comprises the nucleotide sequence of SEQ ID NO: 75 or a nucleotide sequence having greater than 99% identity to SEQ ID NO: 75.

D18. An isolated nucleic acid comprising a polynucleotide that encodes: the polypeptide of SEQ ID NO: 3; a polypeptide comprising an amino acid sequence having greater than 99% identity to SEQ ID NO: 3; or a polypeptide of SEQ ID NO: 3 having 1 to 5 amino acid substitutions.

D19. The isolated nucleic acid of embodiment D18, wherein the polynucleotide comprises the nucleotide sequence of SEQ ID NO: 2 or a nucleotide sequence having greater than 99% identity to SEQ ID NO: 2.

D20. An isolated nucleic acid comprising a polynucleotide that encodes: the polypeptide of SEQ ID NO: 5; a polypeptide comprising an amino acid sequence having greater than 99% identity to SEQ ID NO: 5; or a polypeptide of SEQ ID NO: 5 having 1 to 5 amino acid substitutions.

D21. The isolated nucleic acid of embodiment D20, wherein the polynucleotide comprises the nucleotide sequence of SEQ ID NO: 4 or a nucleotide sequence having greater than 98% identity to SEQ ID NO: 4.

D22. An isolated nucleic acid comprising a polynucleotide that encodes: the polypeptide of SEQ ID NO: 7; a polypeptide comprising an amino acid sequence having greater than 99% identity to SEQ ID NO: 7; or a polypeptide of SEQ ID NO: 7 having 1 to 5 amino acid substitutions.

D23. The isolated nucleic acid of embodiment D22, wherein the polynucleotide comprises the nucleotide sequence of SEQ ID NO: 6 or a nucleotide sequence having greater than 99% identity to SEQ ID NO: 6.

D24. An isolated nucleic acid comprising a polynucleotide that encodes: the polypeptide of SEQ ID NO: 34; a polypeptide comprising an amino acid sequence having greater than 95% identity to SEQ ID NO: 34; or a polypeptide of SEQ ID NO: 34 having 1 to 5 amino acid substitutions.

D25. The isolated nucleic acid of embodiment D24, wherein the polynucleotide comprises the nucleotide sequence of SEQ ID NO: 33 or a nucleotide sequence having greater than 73% identity to SEQ ID NO: 33.

D26. An isolated nucleic acid comprising a polynucleotide that encodes: the polypeptide of SEQ ID NO: 36; a polypeptide comprising an amino acid sequence having greater than 94% identity to SEQ ID NO: 36; or a polypeptide of SEQ ID NO: 36 having 1 to 5 amino acid substitutions.

D27. The isolated nucleic acid of embodiment D3, wherein the polynucleotide comprises the nucleotide sequence of SEQ ID NO: 35 or a nucleotide sequence having greater than 73% identity to SEQ ID NO: 35.

D28. An isolated nucleic acid comprising a polynucleotide that encodes: the polypeptide of SEQ ID NO: 129; a polypeptide comprising an amino acid sequence having greater than 89% identity to SEQ ID NO: 129; or a polypeptide of SEQ ID NO: 129 having 1 to 5 amino acid substitutions.

D29. The isolated nucleic acid of embodiment D28, wherein the polynucleotide comprises the nucleotide sequence of SEQ ID NO: 130 or a nucleotide sequence having greater than 84% identity to SEQ ID NO: 130.

D30. An isolated nucleic acid comprising a polynucleotide that encodes: the polypeptide of SEQ ID NO: 113; a polypeptide comprising an amino acid sequence having greater than 85% identity to SEQ ID NO: 113; or a polypeptide of SEQ ID NO: 113 having 1 to 5 amino acid substitutions.

D31. The isolated nucleic acid of embodiment D30, wherein the polynucleotide comprises the nucleotide sequence of SEQ ID NO: 114 or a nucleotide sequence having greater than 84% identity to SEQ ID NO: 114.

D32. An isolated nucleic acid comprising a polynucleotide that encodes: the polypeptide of SEQ ID NO: 115; a polypeptide comprising an amino acid sequence having greater than 97% identity to SEQ ID NO: 115; or a polypeptide of SEQ ID NO: 115 having 1 to 5 amino acid substitutions.

D33. The isolated nucleic acid of embodiment D32, wherein the polynucleotide comprises the nucleotide sequence of SEQ ID NO: 116 or a nucleotide sequence having greater than 86% identity to SEQ ID NO:116.

D34. An isolated nucleic acid comprising a polynucleotide that encodes: the polypeptide of SEQ ID NO: 117; a polypeptide comprising an amino acid sequence having greater than 80% identity to SEQ ID NO: 117; or a polypeptide of SEQ ID NO: 117 having 1 to 5 amino acid substitutions.

D35. The isolated nucleic acid of embodiment D34, wherein the polynucleotide comprises the nucleotide sequence of SEQ ID NO: 118 or a nucleotide sequence having greater than 80% identity to SEQ ID NO: 118.

D36. An isolated nucleic acid comprising a polynucleotide that encodes: the polypeptide of SEQ ID NO: 119; a polypeptide comprising an amino acid sequence having greater than 84% identity to SEQ ID NO: 119; or a polypeptide of SEQ ID NO: 119 having 1 to 5 amino acid substitutions.

D37. The isolated nucleic acid of embodiment D36, wherein the polynucleotide comprises the nucleotide sequence of SEQ ID NO: 120 or a nucleotide sequence having greater than 76% identity to SEQ ID NO: 120.

D38. An isolated nucleic acid comprising a polynucleotide that encodes: the polypeptide of SEQ ID NO: 121; a polypeptide comprising an amino acid sequence having greater than 81% identity to SEQ ID NO: 121; or a polypeptide of SEQ ID NO: 121 having 1 to 5 amino acid substitutions.

D39. The isolated nucleic acid of embodiment D38, wherein the polynucleotide comprises the nucleotide sequence of SEQ ID NO: 122 or a nucleotide sequence having greater than 74% identity to SEQ ID NO: 122.

D40. An isolated nucleic acid comprising a polynucleotide that encodes: the polypeptide of SEQ ID NO: 123; a polypeptide comprising an amino acid sequence having greater than 90% identity to SEQ ID NO: 123; or a polypeptide of SEQ ID NO: 123 having 1 to 5 amino acid substitutions.

D41. The isolated nucleic acid of embodiment D40, wherein the polynucleotide comprises the nucleotide sequence of SEQ ID NO: 124 or a nucleotide sequence having greater than 82% identity to SEQ ID NO: 124.

D42. An isolated nucleic acid comprising a polynucleotide that encodes: the polypeptide of SEQ ID NO: 125; a polypeptide comprising an amino acid sequence having greater than 80% identity to SEQ ID NO: 125; or a polypeptide of SEQ ID NO: 125 having 1 to 5 amino acid substitutions.

D43. The isolated nucleic acid of embodiment D42, wherein the polynucleotide comprises the nucleotide sequence of SEQ ID NO: 126 or a nucleotide sequence having greater than 77% identity to SEQ ID NO: 126.

D44. An isolated nucleic acid comprising a polynucleotide that encodes: the polypeptide of SEQ ID NO: 127; a polypeptide comprising an amino acid sequence having greater than 81% identity to SEQ ID NO: 127; or a polypeptide of SEQ ID NO: 127 having 1 to 5 amino acid substitutions.

D45. The isolated nucleic acid of embodiment D44, wherein the polynucleotide comprises the nucleotide sequence of SEQ ID NO: 128 or a nucleotide sequence having greater than 78% identity to SEQ ID NO: 128.

D46. An isolated nucleic acid comprising a polynucleotide that encodes: the polypeptide of SEQ ID NO: 96; a polypeptide comprising an amino acid sequence having greater than 85% identity to SEQ ID NO: 96; or a polypeptide of SEQ ID NO: 96 having 1 to 5 amino acid substitutions.

D47. The isolated nucleic acid of embodiment D46, wherein the polynucleotide comprises the nucleotide sequence of SEQ ID NO: 95 or a nucleotide sequence having greater than 72% identity to SEQ ID NO:95

D48. An isolated nucleic acid comprising a polynucleotide that encodes: the polypeptide of SEQ ID NO: 139; a polypeptide comprising an amino acid sequence having greater than 76% identity to SEQ ID NO: 139; or a polypeptide of SEQ ID NO: 139 having 1 to 5 amino acid substitutions.

D49. The isolated nucleic acid of embodiment D48, wherein the polynucleotide comprises the nucleotide sequence of SEQ ID NO: 140 or a nucleotide sequence having greater than 77% identity to SEQ ID NO: 140.

D50. An isolated nucleic acid comprising a polynucleotide that encodes: the polypeptide of SEQ ID NO: 141; a polypeptide comprising an amino acid sequence having greater than 83% identity to SEQ ID NO: 141; or a polypeptide of SEQ ID NO: 141 having 1 to 5 amino acid substitutions.

D51. The isolated nucleic acid of embodiment D50, wherein the polynucleotide comprises the nucleotide sequence of SEQ ID NO: 142 or a nucleotide sequence having greater than 73% identity to SEQ ID NO: 142.

D52. An isolated nucleic acid comprising a polynucleotide that encodes: the polypeptide of SEQ ID NO: 90; a polypeptide comprising an amino acid sequence having greater than 95% identity to SEQ ID NO: 90; or a polypeptide of SEQ ID NO:90 having 1 to 5 amino acid substitutions.

D53. The isolated nucleic acid of embodiment D52, wherein the polynucleotide comprises the nucleotide sequence of SEQ ID NO: 89 or a nucleotide sequence having greater than 81% identity to SEQ ID NO: 89.

D54. An isolated nucleic acid comprising a polynucleotide that encodes: the polypeptide of SEQ ID NO: 40; a polypeptide comprising an amino acid sequence having greater than 92% identity to SEQ ID NO: 40; or a polypeptide of SEQ ID NO: 40 having 1 to 5 amino acid substitutions.

D55. The isolated nucleic acid of embodiment D54, wherein the polynucleotide comprises the nucleotide sequence of SEQ ID NO: 39 or a nucleotide sequence having greater than 84% identity to SEQ ID NO: 39.

D56. An isolated nucleic acid, comprising a polynucleotide that comprises: the nucleotide sequence of SEQ ID NO: 166 or a nucleotide sequence having greater than 84% identity to SEQ ID NO: 166.

D57. An isolated nucleic acid, comprising a polynucleotide that comprises: the nucleotide sequence of SEQ ID NO: 167 or a nucleotide sequence having greater than 85% identity to SEQ ID NO: 167.

D58. An isolated nucleic acid, comprising a polynucleotide that comprises: the nucleotide sequence of SEQ ID NO: 164 or a nucleotide sequence having greater than 92% identity to SEQ ID NO: 169.

D59. The isolated nucleic acid of any one of embodiments D3 to D58, wherein at least one of the 1 to 5 amino acid substitutions is conservative.

D60. The isolated nucleic acid of any one of embodiments D3 to D58, wherein at least one of the 1 to 5 amino acid substitutions is non-conservative.

E1. The isolated nucleic acid of any one of embodiments D1 to D60, which is an expression vector.

E2. A cell comprising a nucleic acid of any one of embodiments D1 to E1.

E3. The cell of embodiment E2, which is a bacterium.

E4. The cell of embodiment E2, which is a yeast.

E5. The cell of embodiment E4, which is a *Candida* spp. yeast.

E6. The cell of embodiment E5, wherein the *Candida* spp. yeast is chosen from *C. tropicalis* and *C. viswanathii*.

E7. The cell of embodiment E6, wherein the *Candida* spp. yeast is a genetically modified ATCC20336 yeast.

E8. The cell of embodiment E4, which is chosen from a *Yarrowia* spp. yeast, *Pichia* spp. yeast, *Saccharomyces* spp. yeast and *Kluyveromyces* spp. yeast.

E9. The cell of embodiment E8, which is chosen from *Y. lipolytica, P. pastoris, P. membranifaciens, P. kluyveri, P. guilliermondii, P. heedii, P. subpelliculosa, S. cerevisiae, S. bayanus, S. pastorianus, S. carlsbergensis, K. lactis* and *K. marxianus*.

The entirety of each patent, patent application, publication and document referenced herein hereby is incorporated by reference. Citation of the above patents, patent applications, publications and documents is not an admission that any of the foregoing is pertinent prior art, nor does it constitute any admission as to the contents or date of these publications or documents.

Modifications may be made to the foregoing without departing from the basic aspects of the technology. Although the technology has been described in substantial detail with reference to one or more specific embodiments, those of ordinary skill in the art will recognize that changes may be made to the embodiments specifically disclosed in this application, yet these modifications and improvements are within the scope and spirit of the technology.

The technology illustratively described herein suitably may be practiced in the absence of any element(s) not specifically disclosed herein. Thus, for example, in each instance herein any of the terms "comprising," "consisting essentially of," and "consisting of" may be replaced with either of the other two terms. The terms and expressions which have been employed are used as terms of description and not of limitation, and use of such terms and expressions do not exclude any equivalents of the features shown and described or portions thereof, and various modifications are possible within the scope of the technology claimed. The term "a" or "an" can refer to one of or a plurality of the elements it modifies (e.g., "a reagent" can mean one or more reagents) unless it is contextually clear either one of the elements or more than one of the elements is described. The term "about" as used herein refers to a value within 10% of the underlying parameter (i.e., plus or minus 10%), and use of the term "about" at the beginning of a string of values modifies each of the values (i.e., "about 1, 2 and 3" refers to about 1, about 2 and about 3). For example, a weight of "about 100 grams" can include weights between 90 grams and 110 grams. Further, when a listing of values is described herein (e.g., about 50%, 60%, 70%, 80%, 85% or 86%) the listing includes all intermediate and fractional values thereof (e.g., 54%, 85.4%). Thus, it should be understood that although the present technology has been specifically disclosed by representative embodiments and optional features, modification and variation of the concepts herein disclosed may be resorted to by those skilled in the art, and such modifications and variations are considered within the scope of this technology.

Certain embodiments of the technology are set forth in the claim(s) that follow(s).

---

SEQUENCE LISTING (483 sequences)

SEQ ID NO: 1 - protein, 419 aa, Cuphea lanceolata
MVAAAATSAFFPVPAPGTSPKPGKSGNWPSSLSPTFKPKSIPNAGFQVKANASAHPKANGSAVNLKSGSLNTQEDTSSSPPPRAFLNQLPDWSMLLTAITTVFVAAEKQWTMLDRKSKRPDMLVDSVGLKSIVRDGLVSRQSFLIRSYEIGADRTASIETLMNHLQETSINHCKSLGLLNDGFGRTPGMCKNDLIWVLTKMQIMVNRYPTWGDTVEINTWFSQSGKIGMASDWLISDCNTGEILIRATSVWAMMNQKTRRFSRLPYEVRQELTPHFVDSPHVIEDNDQKLHKFDVKTGDSIRKGLTPRWNDLDVNQHVSNVKYIGWILESMPIEVLETQELCSLTVEYRRECGMDSVLESVTAVDPSENGGRSQYKHLLRLEDGTDIVKSRTEWRPKNAGTNGAISTSTAKTSNGNSAS

SEQ ID NO: 2 - DNA, 2115 bp, Candida tropicalis
atggctccatttttgcccgaccaggtcgactacaaacacgtcgacacccttatgttattatgtgacgggatcatccacgaaaccaccgtcgaccaaatcaaagacgttattgctcctgacttccctgctgacaagtacgaagagtacgtcaggacattcaccaaaccctccgaaaccccagggttcagggaaaccgtctacaacacagtcaacgcaaacaccacggacgcaatccaccagttcattatcttgaccaatgttttggcatccagggtcttggctccagctttgaccaactcgttgacgcctatcaaggacatgagcttggaagaccgtgaaaaattgttggcctcgtggcgcgactccccaatcgctgccaaaaggaagttgttcaggttggtttctacgcttaccttggtcacgttcacgagattggccaatgagttgcatttgaaagccattcattatccaggaagagaagaccgtgaaaaggcttatgaaacccaggagattgacccttttaagtaccagtttttggaaaaaccgaagttttacggcgctgagttgtacttgccagatattgatgtgatcattattggatctggtgccggtgctggtgttgtggcccacactttggccaacgatggcttcaagagtttggttttggaaaagggcaaatactttagcaactccgagttgaactttgatgacaaggacggcgttcaagaattataccaaagtggaggtactttgactacagtcaaccaacagttgtttgttcttgctggttccacttttggtggcggtaccactgtcaattggtcagcctgtcttaagacgccattcaaggtgcgtaaggaatggtatgatgagtttggtgttgactttgctgctgatgaagcatacgataaagcgcaggattatgtttggcagcaaatgggagcttctaccgaaggcatcacccactctttggctaacgagattattattgaaggtggtaagaaattaggttacaaggccaaggtattagaccaaaacagcggtggtcatcctcagcacagatgcggtttctgttatttgggctgtaagcacggtatcaagcagggttctgttaataactggtttagagacgcagctgcccacggttcccagttcatgcaacaggttagagttttgcaaatacttaacaagaaggggatcgcttacggtatcttgtgtgaggatgttgtaaccggcgccaagttcaccattactggccccaaaaagtttgttgttgctgccggtgctttgaacactccatctgtgttggtcaactccggcttcaagaacaagaacatcggtaagaacttaactttgcacccagtttctgtcgtgtttggtgattttggcaaagacgttcaagcagaccacttccacaactccatcatgactgccctttgttcagaagccgctgatttagacggcaagggccatggatgcagaattgaaaccatcttgaacgctccattcatccaggcttcattcttaccatggagaggtagtaacgaggctagacgagacttgttgcgttacaacaacatggtggcgatgttgctccttagtcgtgacaccaccagtggttccgtttctgctcatccaaccaaacctgaagctttggttgtcgagtacgacgtgaacaagtttgacagaaactcgatcttgcaggcattgttggtcactgctgacttgttgtatatccaaggtgccaagagaatccttagtccacaggcatgggtgccaatttttgaatccgacaagccaaaggataagagatcaatcaaggacgaggactatgtcgaatggagagccaaggttgccaagattcctttcgacacctacggctcaccttatggttcggcacatcaaatgtcttcttgccgtatgtcaggtaagggtcctaaatacggtgctgttgacaccgatggtagattgtttgaatgttcgaatgtttatgttgccgatgcaagtcttttgccaactgcaagcggtgccaaccctatggtcaccaccatgactcttgccagacatgttgcgttaggtttggcagactccttgaagaccaaagccaagttgtag

SEQ ID NO: 3 - protein, 704 aa, Candida tropicalis
MAPFLPDQVDYKHVDTLMLLCDGIIHETTVDQIKDVIAPDFPADKYEEYVRTFTKPSETPGFRETVYNTVNANTTDAIHQFIILTNVLASRVLAPALTNSLTPIKDMSLEDREKLLASWRDSPIAAKRKLFRLVSTLTLVTFTRLANELHLKAIHYPGREDREKAYETQEIDPFKYQFLEKPKFYGAELYLPDIDVIIIGSGAGAGVVAHTLANDGFKSLVLEKGKYFSNSELNFDDKDGVQELYQSGGTLTTVNQQLFVLAGSTFGGGTTVNWSACLKTPFKVRKEWYDEFGVDFAADEAYDKAQDYVWQQMGASTEGITHSLANEIIIEGGKKLGYKAKVLDQNSGGHPQHRCGFCYLGCKHGIKQGSVNNWFRDAAAHGSQFMQQVRVLQILNKKGIAYGILCEDVVTGAKFTITGPKKFVVAAGALNTPSVLVNSGFKNKNIGKNLTLHPVSVVFGDFGKDVQADHFHNSIMTALCSEAADLDGKGHGCRIETILNAPFIQASFLPWRGSNEARRDLLRYNNMVAMLLLSRDTTSGSVSAHPTKPEALVVEYDVNKFDRNSILQALLVTADLLYIQGAKRILSPQAWVPIFESDKPKDKRSIKDEDYVEWRAKVAKIPFDTYGSPYGSAHQMSSCRMSGKGPKYGAVDTDGRLFECSNVYVADASLLPTASGANPMVTTMTLARHVALGLADSLKTKAKL

SEQ ID NO: 4 - DNA, 2115 bp, Candida tropicalis
atggctccatttttgcccgaccaggtcgactacaaacacgtcgacacccttatgttattatgtgacgggatcatccacgaaaccaccgtggacgaaatcaaagacgtcattgcccctgacttccccgccgacaaatacgaggagtacgtcaggacattcaccaaaccctccgaaaccccagggttcagggaaaccgtctacaacaccgtcaacgcaaacaccatggatgcaatccaccagttcattatcttgaccaatgttttgggatcaagggtcttggcaccagctttgaccaactcgttgactcctatcaaggacatgagcttggaagaccgtgaaaagttgttagcctcgtggcgtgactcccctattgctgctaaaaggaagttgttcaggttggtttctacgcttaccttggtcacgttcacgagattggccaatgagttgcatttgaaagccattcattatccaggaagagaagaccgtgaaaaggcttatgaaacccaggagattgacccttttaagtaccagtttttggaaaaaccgaagttttacggcgctgagttgtacttgccagatattgatgtgatcattattggatctggtgccggtgctggtgttgtggcccacactttggccaacgatggcttcaagagtttggttttggaaaagggcaaatactttagcaactccgagttgaactttgatgacaaggacggcgttcaagaattataccaaagtggaggtactttgactacagtcaaccaacagttgtttgttcttgctggttccacttttggtggcggtaccactgtcaattggtcagcctgtcttaagacgccattcaaggtgcgtaaggaatggtatgatgagtttggtgttgactttgctgctgatgaagcatacgataaagcgcaggattatgtttggcagcaaatgggagcttctaccgaaggcatcacccactctttggctaacgagattattattgaaggtggtaagaaattaggttacaaggccaaggtattagaccaaaacagcggtggtcatcctcagcacagatgcggtttctgttatttgggttgtaagcacggtatcaagcagggctctgttaataactggtttagagacgcagctgcccacggttctcagttcatgcaacaggttagagttttgcaaatccttaacaagaagggcatcgcttatggtatcttgtgtgaggatgttgtaaccggtgccaagttcaccattactggccccaaaaagtttgttgttgccgccggcgccttaaacactccatctgtgttggtcaactccggattcaagaacaagaacatcggtaagaacttaactttgcatccagtttctgtcgtgtttggtgattttggcaaagacgttcaagcagaccacttccacaactccatcatgactgccctttgttcagaagccgctgatttagacggcaagggccatggatgcagaattgaaaccatcttgaacgctccattcatccaggcttcattcttaccatggagaggtagtaacgaggctagacgagacttgttgcgttacaacaacatggtggcgatgttgctccttagtcgtgacaccaccagtggttccgtttctgctcatccaaccaaacctgaagctttggttgtcgagtacgacgtgaacaagtttgacagaaactcgatcttgcaggcattgttggtcactgctgacttgttgtatatccaaggtgccaagagaatccttagtccacaggcatgggtgccaatttttgaatccgacaagccaaaggataagagatcaatcaaggacgaggactatgtcgaatggagagccaaggttgccaagattcctttcgacacctacggctcaccttatggttcggcacatcaaatgtcttcttgccgtatgtcaggtaagggtcctaaatacggtgctgttgacaccgatggtagattgtttgaatgttcgaatgtttatgttgccgatgcaagtcttttgccaactgcaagcggtgccaaccctatggtcaccaccatgactcttgcaagacatgttgcgttaggtttggcagactccttgaagaccaaggccaagttgtag

SEQ ID NO: 5 - protein, 704 aa, Candida tropicalis
MAPFLPDQVDYKHVDTLMLLCDGIIHETTVDEIKDVIAPDFPADKYEEYVRTFTKPSETPGFRETVYNTVNANTMDAIHQFIILTNVLGSRVLAPALTNSLTPIKDMSLEDREKLLASWRDSPIAAKRKLFRLVSTLTLVTFTRLANELHLKAIHYPGREDREKAYETQEIDPFKYQFLEKPKFYGAELYLPDIDVIIIGSGAGAGVVAHTLANDGFKSLVLEKGKYFSNSELNFDDKDGVQELYQSGGTLTTVNQQLFVLAGSTFGGGTTVNWSACLKTPFKVRKEWYDEFGVDFAADEAYDKAQDYVWQQMGASTEGITHSLANEIIIEGGKKLGYKAKVLDQNSGGHPQHRCGFCYLGCKHGIKQGSVNNWFRDAAAHGSQFMQQVRVLQILNKKGIAYGILCEDVVTGAKFTITGPKKFVVAAGALNTPSVLVNSGFKNKNIGKNLTLHPVSVVFGDFGKDVQADHFHNSIMTALCSEAADLDGKGHGCRIETILNAPFIQASFLPWRGSNEARRDLLRYNNMVAMLLLSRDTTSGSVSAHPTKPEALVVEYDVNKFDRNSILQALLVTADLLYIQGAKRILSPQAWVPIFESDKPKDKRSIKDEDYVEWRAKVAKIPFDTYGSPYGSAHQMSSCRMSGKGPKYGAVDTDGRLFECSNVYVADASLLPTASGANPMVTTMTLARHVALGLADSLKTKAKL

SEQ ID NO: 6 - DNA, 2115 bp, Candida tropicalis
atggctccatttttgcccgaccaggtcgactacaaacacgtcgacacccttatgttattatgtgacgggatcatccacgaaaccaccgtcgaccaaatcaaagacgttattgctcctgacttccctgctgacaagtacgaagagtacgtcaggacattcaccaaaccctccgaaaccccagggttcagggaaaccgtctacaacacagtcaacgcaaacaccacggacgcaatccaccagttcattatcttgaccaatgttttggcatccagggtcttggctccagctttgaccaactcgttgacgcctatcaaggacatgagcttggaagaccgtgaaaaattgttggcctcgtggcgcgactccccaatcgctgccaaaaggaaattgttcaggttggtttccacgcttaccttggttactttcacgagattggccaatgagttgcatttgaaagccattcactatccaggaagagaagaccgtgaaaaggcttatgaaacccaggagattgaccctttcaagtaccagtttatggaaaagccaaagtttgacggcgctgagttgtacttgccagatattgatgttatcattattggatctggtgccggtgctggtgttgtggcccacactttggccaacgatggcttcaagagtttggttttggaaaagggcaaatactttagcaactccgagttgaactttgatgacaaggacggcgttcaagaattataccaaagtggaggtactttgactacagtcaaccaacagttgtttgttcttgctggttccacttttggtggcggtaccactgtcaattggtcagcctgtcttaagacgccattcaaggtgcgtaaggaatggtatgatgagtttggtgttgactttgctgctgatgaagcatacgataaagcgcaggattatgtttggcagcaaatgggagcttctaccgaaggcatcacccactctttggctaacgagattattattgaaggtggtaagaaattaggttacaaggccaaggtattagaccaaaacagcggtggtcatcctcagcacagatgcggtttctgttatttgggctgtaagcacggtatcaagcagggttctgttaataactggtttagagacgcagctgcccacggttcccagttcatgcaacaggttagagttttgcaaatacttaacaagaaggggatcgcttacggtatcttgtgtgaggatgttgtaaccggcgccaagttcaccattactggccccaaaaagtttgttgttgctgccggtgctttgaacactccatctgtgttggtcaactccggcttcaagaacaagaacatcggtaagaacttaactttgcacccagtttctgtcgtgtttggtgattttggcaaagacgttcaagcagaccacttccacaactccatcatgactgccctttgttcagaagccgctgatttagacggcaagggccatggatgcagaattgaaaccatcttgaacgctccattcatccaggcttcattcttaccatggagaggtagtaacgaggctagacgagacttgttgcgttacaacaacatggtggcgatgttgctccttagtcgtgacaccaccagtggttccgtttctgctcatccaaccaaacctgaagctttggttgtcgagtacgacgtgaacaagtttgacagaaactcgatcttgcaggcattgttggtcactgctgacttgttgtatatccaaggtgccaagagaatccttagtccacaggcatgggtgccaatttttgaatccgacaagccaaaggataagagatcaatcaaggacgaggactatgtcgaatggagagccaaggttgccaagattcctttcgacacctacggctcaccttatggttcggcacatcaaatgtcttcttgccgtatgtcaggtaagggtcctaaatacggtgctgttgacaccgatggtagattgtttgaatgttcgaatgtttatgttgccgatgcaagtcttttgccaactgcaagcggtgccaaccctatggtcaccaccatgactcttgccagacatgttgcgttaggtttggcagactccttgaagaccaaagccaagttgtag

SEQ ID NO: 7 - protein, 704 aa, Candida tropicalis
MAPFLPDQVDYKHVDTLMLLCDGIIHETTVDQIKDVIAPDFPADKYEEYVRTFTKPSETPGFRETVYNTVNANTTDAIHQFIILTNVLASRVLAPALTNSLTPIKDMSLEDREKLLASWRDSPIAAKRKLFRLVSTLTLVTFTRLANELHLKAIHYPGREDREKAYETQEIDPFKYQFMEKPKFDGAELYLPDIDVIIIGSGAGAGVVAHTLANDGFKSLVLEKGKYFSNSELNFDDKDGVQELYQSGGTLTTVNQQLFVLAGSTFGGGTTVNWSACLKTPFKVRKEWYDEFGVDFAADEAYDKAQDYVWQQMGASTEGITHSLANEIIIEGGKKLGYKAKVLDQNSGGHPQHRCGFCYLGCKHGIKQGSVNNWFRDAAAHGSQFMQQVRVLQILNKKGIAYGILCEDVVTGAKFTITGPKKFVVAAGALNTPSVLVNSGFKNKNIGKNLTLHPVSVVFGDFGKDVQADHFHNSIMTALCSEAADLDGKGHGCRIETILNAPFIQASFLPWRGSNEARRDLLRYNNMVAMLLLSRDTTSGSVSAHPTKPEALVVEYDVNKFDRNSILQALLVTADLLYIQGAKRILSPQAWVPIFESDKPKDKRSIKDEDYVEWRAKVAKIPFDTYGSPYGSAHQMSSCRMSGKGPKYGAVDTDGRLFECSNVYVADASLLPTASGANPMVTTMTLARHVALGLADSLKTKAKL

SEQ ID NO: 8 - DNA, 2115 bp, Candida tropicalis
atgaataccttcttgccagacgtgctcgaatacaaacacgtcgacacccttttgttattgtgtgacgggatcatccacgaaaccacagtcgatcagatcaaggacgccattgctcccgacttccctgaggaccagtacgaggagtatctcaagaccttcaccaagccatctgagacccctgggttcagagaagccgtctacgacacgatcaacgccaccccaaccgatgccgtgcacatgtgtattgtcttgaccaccgcattggactccagaatcttggcccccacgttgaccaactcgttgacgcctatcaaggatatgaccttgaaggagcgtgaacaattgttggcctcttggcgtgattccccgattgcggcaaagagaagattgttcagattgatttcctcgcttaccttgacgacgtttacgagattggccagcgaattgcacttgaaagccatccactaccctggcagagacttgcgtgaaaaggcgtatgaaacccaggtggttgaccctttcaggtacctgtttatggagaaaccaaagtttgacggcgccgaattgtacttgccagatatcgacgtcatcatcattggatcaggcgccggtgctggtgtcatggcccacactctcgccaacgacgggttcaagaccttggttttggaaaagggaaagtatttcagcaactccgagttgaactttaatgacgctgatggcgtgaaagagttgtaccaaggtaaaggtgctttggccaccaccaatcagcagatgtttattcttgccggttccactttgggcggtggtaccactgtcaactggtctgcttgccttaaaacaccatttaaagtgcgtaaggagtggtacgacgagtttggtcttgaatttgctgccgatgaagcctacgacaaagcgcaggattatgtttggaaacaaatgggtgcttcaacagatggaatcactcactccttggccaacgaagttgtggttgaaggaggtaagaagttgggctacaagagcaaggaaattgagcagaacaacggtggccaccctgaccacccatgtggtttctgttacttgggctgtaagtacggtattaaacagggttctgtgaataactggtttagagacgcagctgcccacgggtccaagttcatgcaacaagtcagagttgtgcaaatcctcaacaagaatggcgtcgcttatggtatcttgtgtgaggatgtcgaaaccggagtcaggttcactattagtggccccaaaaagtttgttgtttctgctggttctttgaacacgccaactgtgttgaccaactccggattcaagaacaagcacattggtaagaacttgacgttgcacccagtttccaccgtgtttggtgactttggcagagacgtgcaagccgaccatttccacaaatctattatgacttcgctttgttacgaggttgctgacttggacggcaagggccacggatgcagaatcgaaaccatcttgaacgctccattcatccaagcttctttgttgccatggagaggaagtgacgaggtcagaagagacttgttgcgttacaacaacatggtggccatgttgcttatcacgcgtgataccaccagtggttcagtttctgctgacccaaagaagcccgacgctttgattgtcgactatgagattaacaagtttgacaagaatgccatcttgcaagctttcttgatcacttccgacatgttgtacattgaaggtgccaagagaatcctcagtccacagccatgggtgccaatctttgagtcgaacaagccaaaggagcaaagaacgatcaaggacaaggactatgttgagtggagagccaaggctgctaagatacctttcgacacctacggttctgcatatgggtccgcacatcaaatgtccacctgtcgtatgtccggaaagggtcctaaatacggtgctgttgatactgatggtagattgtttgaatgttcgaatgtctatgttgctgatgctagtgttttgcctactgccagcggtgccaacccaatgatatccaccatgacctttgctagacagattgcgttaggtttggctgactccttgaagaccaaacccaagttgtag

SEQ ID NO: 9 - protein, 704 aa, Candida tropicalis
MNTFLPDVLEYKHVDTLLLLCDGIIHETTVDQIKDAIAPDFPEDQYEEYLKTFTKPSETPGFREAVYDTINATPTDAVHMCIVLTTALDSRILAPTLTNSLTPIKDMTLKEREQLLASWRDSPIAAKRRLFRLISSLTLTTFTRLASELHLKAIHYPGRDLREKAYETQVVDPFRYSFMEKPKFDGAELYLPDIDVIIIGSGAGAGVMAHTLANDGFKTLVLEKGKYFSNSELNFNDADGVKELYQGKGALATTNQQMFILAGSTLGGGTTVNWSACLKTPFKVRKEWYDEFGLEFAADEAYDKAQDYVWKQMGASTDGITHSLANEVVVEGGKKLGYKSKEIEQNNGGHPDHPCGFCYLGCKYGIKQGSVNNWFRDAAAHGSKFMQQVRVVQILNKNGVAYGILCEDVETGVRFTISGPKKFVVSAGSLNTPTVLTNSGFKNKHIGKNLTLHPVSTVFGDFGRDVQADHFHKSIMTSLCYEVADLDGKGHGCRIETILNAPFIQASLLPWRGSDEVRRDLLRYNNMVAMLLITRDTTSGSVSADPKKPDALIVDYEINKFDKNAILQAFLITSDMLYIEGAKRILSPQPWVPIFESNKPKEQRTIKDKDYVEWRAKAAKIPFDTYGSAYGSAHQMSTCRMSGKGPKYGAVDTDGRLFECSNVYVADASVLPTASGANPMISTMTFARQIALGLADSLKTKPKL

SEQ ID NO: 10 - DNA, 2115 bp, Candida tropicalis
atgaataccttcttgccagacgtgctcgaatacaaacacgtcgatacccttttgttattatgtgacgggatcatccacgaaaccacagtcgaccagatcagggacgccattgctcccgacttccctgaagaccagtacgaggagtatctcaagaccttcaccaagccatctgagacccctgggttcagagaagccgtctacgacacgatcaacagcaccccaaccgaggctgtgcacatgtgtattgtattgaccaccgcattggactcgagaatcttggcccccacgttgaccaactcgttgacgcctatcaaggatatgaccttgaaagagcgtgaacaattgttggctgcctggcgtgattccccgatcgcggccaagagaagattgttcagattgatttcctcacttaccttgacgacctttacgagattggccagcgacttgcacttgagagccatccactaccctggcagagacttgcgtgaaaaggcatatgaaacccaggtggttgaccctttcaggtacctgtttatggaaaaaccaaagtttgacggcaccgagttgtacttgccagatatcgacgtcatcatcattggatccggtgccggtgctggtgtcatggcccacactttagccaacgacgggtacaagaccttggttttggaaaagggaaagtatttcagcaactccgagttgaactttaatgatgccgatggtatgaaagagttgtaccaaggtaaatgtgcgttgaccaccacgaaccagcagatgtttattcttgccggttccactttgggcggtggtaccactgttaactggtctgcttgtcttaaaacaccatttaaagtgcgtaaggagtggtacgacgagtttggtcttgaatttgctgccgacgaagcctacgacaaagcacaagactatgtttggaaacaaatgggcgcttctaccgaaggaatcactcactctttggcgaacgcggttgtggttgaaggaggtaagaagttgggttacaagagcaaggaaatcgagcagaacaatggtggccatcctgaccacccctgtggtttctgttacttgggctgtaagtacggtattaagcagggttctgtgaataactggtttagagacgcagctgcccacgggtccaagttcatgcaacaagtcagagttgtgcaaatcctccacaataaaggcgtcgcttatggcatcttgtgtgaggatgtcgagaccggagtcaaattcactatcagtggccccaaaaagtttgttgtttctgcaggttctttgaacacgccaacggtgttgaccaactccggattcaagaacaaacacatcggtaagaacttgacgttgcacccagtttcgaccgtgtttggtgactttggcagagacgtgcaagccgaccatttccacaaatctattatgacttcgctctgttacgaagtcgctgacttggacggcaagggccacggatgcagaatcgagaccatcttgaacgctccattcatccaagcttctttgttgccatggagaggaagcgacgaggtcagaagagacttgttgcgttacaacaacatggtggccatgttgcttatcacccgtgacaccaccagtggttcagtttctgctgacccaaagaagcccgacgctttgattgtcgactatgacatcaacaagtttgacaagaatgccatcttgcaagctttcttgatcacctccgacatgttgtacatcgaaggtgccaagagaatcctcagtccacaggcatgggtgccaatctttgagtcgaacaagccaaaggagcaaagaacaatcaaggacaaggactatgtcgaatggagagccaaggctgccaagatacctttcgacacctacggttctgcctatgggtccgcacatcaaatgtccacctgtcgtatgtccggaaagggtcctaaatacggcgccgttgataccgatggtagattgtttgaatgttcgaatgtctatgttgctgatgctagtgttttgcctactgccagcggtgccaacccaatgatctccaccatgacgtttgctagacagattgcgttaggtttggctgactctttgaagaccaaacccaagttgtag

SEQ ID NO: 11 - protein, 638 aa, Candida tropicalis
MNTFLPDVLEYKHVDTLLLLCDGIIHETTVDQIRDAIAPDFPEDQYEEYLKTFTKPSETPGFREAVYDTINSTPTEAVHMCIVLTTALDSRILAPTLTNSLTPIKDMTLKEREQLLAAWRDSPIAAKRRLFRLISSLTLTTFTRLASDLHLRAIHYPGRDLREKAYETQVVDPFRYSFMEKPKFDGTELYLPDIDVIIIGSGAGAGVMAHTLANDGYKTLVLEKGKYFSNSELNFNDADGMKELYQGKCALTTTNQQMFILAGSTLGGGTTVNWSACLKTPFKVRKEWYDEFGLEFAADEAYDKAQDYVWKQMGASTEGITHSLANAVVVEGGKKLGYKSKEIEQNNGGHPDHPCGFCYLGCKYGIKQGSVNNWFRDAAAHGSKFMQQVRVVQILHNKGVAYGILCEDVETGVKFTISGPKKFVVSAGSLNTPTVLTNSGFKNKHIGKNLTLHPVSTVFGDFGRDVQADHFHKSIMTSLCYEVADLDGKGHGCRIETILNAPFIQASLLPWRGSDEVRRDLLRYNNMVAMLLITRDTTSGSVSADPKKPDALIVDYDINKFDKNAILQAFLITSDMLYIEGAKRILSPQAWVPIFESNKPKEQRTIKDKDYVEWRAKAAKIPFDTYGSAYGSAHQMST

SEQ ID NO: 12 - DNA, 2115 bp, Candida tropicalis
atggctccatttttgcccgaccaggtcgactacaaacacgtcgacacccttatgttattatgtgacgggatcatccacgaaaccaccgtggacgaaatcaaagacgtcattgcccctgacttccccgccgacaaatacgaggagtacgtcaggacattcaccaaaccctccgaaaccccagggttcagggaaaccgtctacaacaccgtcaacgcaaacaccatggatgcaatccaccagttcattatcttgaccaatgttttgggatcaagggtcttggcaccagctttgaccaactcgttgactcctatcaaggacatgagcttggaagaccgtgaaaagttgttagcctcgtggcgtgactcccctattgctgctaaaaggaagttgttcaggttggtttctacgcttaccttggtcacgttcacgagattggccaatgagttgcatttgaaagccattcattatccaggaagagaagaccgtgaaaaggcttatgaaacccaggagattgacccttttaagtaccagtttttggaaaaaccgaagttttacggcgctgagttgtacttgccagatattgatgtgatcattattggatctggggccggtgctggtgtcgtggcccacactttgaccaacgacggcttcaagagtttggttttggaaaagggcagatactttagcaactccgagttgaactttgatgacaaggacggggttcaagaattataccaaagtggaggtactttgaccaccgtcaaccagcagttgtttgttcttgctggttccacttttggtggtggtaccactgtcaattggtcggcctgtcttaaaacgccattcaaggtgcgtaaggaatggtatgatgagtttggcgttgactttgctgccgatgaagcctacgacaaagcacaggattatgtttggcagcaaatgggagcttctaccgaaggcatcacccactctttggctaacgagattattattgaaggtggcaagaaattaggttacaaggccaaggtattagaccaaaacagcggtggtcatcctcatcacagatgcggtttctgttatttgggttgtaagcacggtatcaagcagggctctgttaataactggtttagagacgcagctgcccacggttctcagttcatgcaacaggttagagttttgcaaatccttaacaagaagggcatcgcttatggtatcttgtgtgaggatgttgtaaccggtgccaagttcaccattactggccccaaaaagtttgttgttgccgccggcgccttaaacactccatctgtgttggtcaactccggattcaagaacaagaacatcggtaagaacttaactttgcatccagtttctgtcgtgtttggtgattttggcaaagacgttcaagcagatcacttccacaactccatcatgactgctctttgttcagaagccgctgatttagacggcaagggtcatggatgcagaattgaaaccatcttgaacgctccattcatccaggcttcattcttaccatggagaggtagtaacgaggctagacgagacttgttgcgttacaacaacatggtggccatgttacttcttagtcgtgataccaccagtggttccgtttcgtcccatccaactaaacctgaagcattagttgtcgagtacgacgtgaacaagtttgacagaaactccatcttgcaggcattgttggtcactgctgacttgttgtacattcaaggtgccaagagaatccttagtccccaaccatgggtgccaatttttgaatccgacaagccaaaggataagagatcaatcaaggacgaggactatgtcgaatggagagccaaggttgccaagattccttttgacacctacggctcgccttatggttcggcgcatcaaatgtcttcttgtcgtatgtcaggtaagggtcctaaatacggtgctgttgataccgatggtagattgtttgaatgttcgaatgtttatgttgctgacgctagtcttttgccaactgctagcggtgctaatcctatggtcaccaccatgactcttgcaagacatgttgcgttaggtttggcagactccttgaagaccaaggccaagttgtag

SEQ ID NO: 13 - protein, 704 aa, Candida tropicalis
MAPFLPDQVDYKHVDTLMLLCDGIIHETTVDEIKDVIAPDFPADKYEEYVRTFTKPSETPGFRETVYNTVNANTMDAIHQFIILTNVLGSRVLAPALTNSLTPIKDMSLEDREKLLASWRDSPIAAKRKLFRLVSTLTLVTFTRLANELHLKAIHYPGREDREKAYETQEIDPFKYQFLEKPKFYGAELYLPDIDVIIIGSGAGAGVVAHTLTNDGFKSLVLEKGRYFSNSELNFDDKDGVQELYQSGGTLTTVNQQLFVLAGSTFGGGTTVNWSACLKTPFKVRKEWYDEFGVDFAADEAYDKAQDYVWQQMGASTEGITHSLANEIIIEGGKKLGYKAKVLDQNSGGHPHHRCGFCYLGCKHGIKQGSVNNWFRDAAAHGSQFMQQVRVLQILNKKGIAYGILCEDVVTGAKFTITGPKKFVVAAGALNTPSVLVNSGFKNKNIGKNLTLHPVSVVFGDFGKDVQADHFHNSIMTALCSEAADLDGKGHGCRIETILNAPFIQASFLPWRGSNEARRDLLRYNNMVAMLLLSRDTTSGSVSSHPTKPEALVVEYDVNKFDRNSILQALLVTADLLYIQGAKRILSPQPWVPIFESDKPKDKRSIKDEDYVEWRAKVAKIPFDTYGSPYGSAHQMSSCRMSGKGPKYGAVDTDGRLFECSNVYVADASLLPTASGANPMVTTMTLARHVALGLADSLKTKAKL

SEQ ID NO: 14 - DNA, 1572 bp, Candida tropicalis
atggccacacaagaaatcatcgattctgtacttccgtacttgaccaaatggtacactgtgattactgcagcagtattagtcttccttatctccacaaacatcaagaactacgtcaaggcaaagaaattgaaatgtgtcgatccaccatacttgaaggatgccggtctcactggtattctgtctttgatcgccgccatcaaggccaagaacgacggtagattggctaactttgccgatgaagttttcgacgagtacccaaaccacaccttctacttgtctgttgccggtgctttgaagattgtcatgactgttgacccagaaaacatcaaggctgtcttggccacccaattcactgacttctccttgggtaccagacacgcccactttgctcctttgttgggtgacggtatcttcaccttggacggagaaggttggaagcactccagagctatgttgagaccacagtttgctagagaccagattggacacgttaaagccttggaaccacacatccaaatcatggctaagcagatcaagttgaaccagggaaagactttcgatatccaagaattgttctttagatttaccgtcgacaccgctactgagttcttgtttggtgaatccgttcactccttgtacgatgaaaaattgggcatcccaactccaaacgaaatcccaggaagagaaaactttgccgctgctttcaacgtttcccaacactacttggccaccagaagttactcccagactttttactttttgaccaaccctaaggaattcagagactgtaacgccaaggtccaccacttggccaagtactttgtcaacaaggccttgaactttactcctgaagaactcgaagagaaatccaagtccggttacgttttcttgtacgaattggttaagcaaaccagagatccaaaggtcttgcaagatcaattgttgaacattatggttgccggaagagacaccactgccggtttgttgtcctttgctttgtttgaattggctagacacccagagatgtggtccaagttgagagaagaaatcgaagttaactttggtgttggtgaagactcccgcgttgaagaaattaccttcgaagccttgaagagatgtgaatacttgaaggctatccttaacgaaaccttgcgtatgtacccatctgttcctgtcaactttagaaccgccaccagagacaccactttgccaagaggtggtggtgctaacggtaccgacccaatctacattcctaaaggctccactgttgcttacgttgtctacaagacccaccgtttggaagaatactacggtaaggacgctaacgacttcagaccagaaagatggtttgaaccatctactaagaagttgggctgggcttatgttccattcaacggtggtccaagagtctgcttgggtcaacaattcgccttgactgaagcttcttatgtgatcactagattggcccagatgtttgaaactgtctcatctgatccaggtctcgaataccctccaccaaagtgtattcacttgaccatgagtcacaacgatggtgtctttgtcaagatgtaa

SEQ ID NO: 15 - DNA, 1569 bp, Candida tropicalis
atgactgtacacgatattatcgccacatacttcaccaaatggtacgtgatagtaccactcgctttgattgcttatagagtcctcgactacttctatggcagatacttgatgtacaagcttggtgctaaaccatttttccagaaacagacagacggctgtttcggattcaaagctccgcttgaattgttgaagaagaagagcgacggtaccctcatagacttcacactccagcgtatccacgatctcgatcgtcccgatatcccaactttcacattcccggtcttttccatcaaccttgtcaatacccttgagccggagaacatcaaggccatcttggccactcagttcaacgatttctccttgggtaccagacactcgcactttgctcctttgttgggtgatggtatctttacgttggatggcgccggctggaagcacagcagatctatgttgagaccacagtttgccagagaacagatttcccacgtcaagttgttggagccacacgttcaggtgttcttcaaacacgtcagaaaggcacagggcaagacttttgacatccaggaattgtttttcagattgaccgtcgactccgccaccgagtttttgtttggtgaatccgttgagtccttgagagatgaatctatcggcatgtccatcaatgcgcttgactttgacggcaaggctggctttgctgatgcttttaactattcgcagaattatttggcttcgagagcggttatgcaacaattgtactgggtgttgaacgggaaaaagtttaaggagtgcaacgctaaagtgcacaagtttgctgactactacgtcaacaaggctttggacttgacgcctgaacaattggaaaagcaggatggttatgtgtttttgtacgaattggtcaagcaaaccagagacaagcaagtgttgagagaccaattgttgaacatcatggttgctggtagagacaccaccgccggtttgttgtcgtttgttttctttgaattggccagaaacccagaagttaccaacaagttgagagaagaaattgaggacaagtttggactcggtgagaatgctagtgttgaagacatttcctttgagtcgttgaagtcctgtgaatacttgaaggctgttctcaacgaaaccttgagattgtacccatccgtgccacagaatttcagagttgccaccaagaacactaccctcccaagaggtggtggtaaggacgggttgtctcctgttttggtgagaaagggtcagaccgttatttacggtgtctacgcagcccacagaaacccagctgtttacggtaaggacgctcttgagtttagaccagagagatggtttgagccagagacaaagaagcttggctgggccttcctcccattcaacggtggtccaagaatctgtttgggacagcagtttgccttgacagaagcttcgtatgtcactgtcaggttgctccaggagtttgcacacttgtctatggacccagacaccgaatatccacctaagaaaatgtcgcatttgaccatgtcgcttttcgacggtgccaatattgagatgtattag

SEQ ID NO: 16 - DNA, 1569 bp, Candida tropicalis
atgactgcacaggatattatcgccacatacatcaccaaatggtacgtgatagtaccactcgctttgattgcttatagggtcctcgactacttttacggcagatacttgatgtacaagcttggtgctaaaccgtttttccagaaacaaacagacggttatttcggattcaaagctccacttgaattgttaaaaaagaagagtgacggtaccctcatagacttcactctcgagcgtatccaagcgctcaatcgtccagatatcccaacttttacattcccaatcttttccatcaaccttatcagcacccttgagccggagaacatcaaggctatcttggccacccagttcaacgatttctccttgggcaccagacactcgcactttgctcctttgttgggcgatggtatctttaccttggacggtgccggctggaagcacagcagatctatgttgagaccacagtttgccagagaacagatttcccacgtcaagttgttggagccacacatgcaggtgttcttcaagcacgtcagaaaggcacagggcaagacttttgacatccaagaattgtttttcagattgaccgtcgactccgccactgagtttttgtttggtgaatccgttgagtccttgagagatgaatctattgggatgtccatcaatgcacttgactttgacggcaaggctggctttgctgatgcttttaactactcgcagaactatttggcttcgagagcggttatgcaacaattgtactgggtgttgaacgggaaaaagtttaaggagtgcaacgctaaagtgcacaagtttgctgactattacgtcagcaaggctttggacttgacacctgaacaattggaaaagcaggatggttatgtgttcttgtacgagttggtcaagcaaaccagagacaggcaagtgttgagagaccagttgttgaacatcatggttgccggtagagacaccaccgccggtttgttgtcgtttgttttctttgaattggccagaaacccagaggtgaccaacaagttgagagaagaaatcgaggacaagtttggtcttggtgagaatgctcgtgttgaagacatttcctttgagtcgttgaagtcatgtgaatacttgaaggctgttctcaacgaaactttgagattgtacccatccgtgccacagaatttcagagttgccaccaaaaacactacccttccaaggggaggtggtaaggacgggttatctcctgttttggtcagaaagggtcaaaccgttatgtacggtgtctacgctgcccacagaaacccagctgtctacggtaaggacgcccttgagtttagaccagagaggtggtttgagccagagacaaagaagcttggctgggccttccttccattcaacggtggtccaagaatttgcttgggacagcagtttgccttgacagaagcttcgtatgtcactgtcagattgctccaagagtttggacacttgtctatggaccccaacaccgaatatccacctaggaaaatgtcgcatttgaccatgtcccttttcgacggtgccaacattgagatgtattag

SEQ ID NO: 17 - DNA, 1623 bp, Candida tropicalis
atgtcgtcttctccatcgtttgcccaagaggttctcgctaccactagtccttacatcgagtactttcttgacaactacaccagatggtactacttcatacctttggtgcttctttcgttgaactttataagtttgctccacacaaggtacttggaacgcaggttccacgccaagccactcggtaactttgtcagggaccctacgtttggtatcgctactccgttgcttttgatctacttgaagtcgaaaggtacggtcatgaagtttgcttggggcctctggaacaacaagtacatcgtcagagacccaaagtacaagacaactgggctcaggattgttggcctcccattgattgaaaccatggacccagagaacatcaaggctgttttggctactcagttcaatgatttctctttgggaaccagacacgatttcttgtactccttgttgggtgacggtattttcaccttggacggtgctggctggaaacatagtagaactatgttgagaccacagtttgctagagaacaggtttctcacgtcaagttgttggagccacacgttcaggtgttcttcaagcacgttagaaagcaccgcggtcaaacgttcgacatccaagaattgttcttcaggttgaccgtcgactccgccaccgagttcttgtttggtgagtctgctgaatccttgagggacgaatctattggattgaccccaaccaccaaggatttcgatggcagaagagatttcgctgacgctttcaactattcgcagacttaccaggcctacagatttttgttgcaacaaatgtactggatcttgaatggctcggaattcagaaagtcgattgctgtcgtgcacaagtttgctgaccactatgtgcaaaaggctttggagttgaccgacgatgacttgcagaaacaagacggctatgtgttcttgtacgagttggctaagcaaaccagagacccaaaggtcttgagagaccagttattgaacattttggttgccggtagagacacgaccgccggtttgttgtcatttgttttctacgagttgtcaagaaaccctgaggtgtttgctaagttgagagaggaggtggaaaacagatttggactcggtgaagaagctcgtgttgaagagatctcgtttgagtccttgaagtcttgtgagtacttgaaggctgtcatcaatgaaaccttgagattgtacccatcggttccacacaactttagagttgctaccagaaacactaccctcccaagaggtggtggtgaagatggatactcgccaattgtcgtcaagaagggtcaagttgtcatgtacactgttattgctacccacagagacccaagtatctacggtgccgacgctgacgtcttcagaccagaaagatggtttgaaccagaaactagaaagttgggctgggcatacgttccattcaatggtggtccaagaatctgtttgggtcaacagtttgccttgaccgaagcttcatacgtcactgtcagattgctccaggagtttgcacacttgtctatggacccagacaccgaatatccaccaaaattgcagaacaccttgaccttgtcgctctttgatggtgctgatgttagaatgtactaa

SEQ ID NO: 18 - DNA, 1623 bp, Candida tropicalis
atgtcgtcttctccatcgtttgctcaggaggttctcgctaccactagtccttacatcgagtactttcttgacaactacaccagatggtactacttcatccctttggtgcttctttcgttgaacttcatcagcttgctccacacaaagtacttggaacgcaggttccacgccaagccgctcggtaacgtcgtgttggatcctacgtttggtatcgctactccgttgatcttgatctacttaaagtcgaaaggtacagtcatgaagtttgcctggagcttctggaacaacaagtacattgtcaaagacccaaagtacaagaccactggccttagaattgtcggcctcccattgattgaaaccatagacccagagaacatcaaagctgtgttggctactcagttcaacgatttctccttgggaactagacacgatttcttgtactccttgttgggcgatggtatttttaccttggacggtgctggctggaaacacagtagaactatgttgagaccacagtttgctagagaacaggtttcccacgtcaagttgttggaaccacacgttcaggtgttcttcaagcacgttagaaaacaccgcggtcagacttttgacatccaagaattgttcttcagattgaccgtcgactccgccaccgagttcttgtttggtgagtctgctgaatccttgagagacgactctgttggtttgaccccaaccaccaaggatttcgaaggcagaggagatttcgctgacgctttcaactactcgcagacttaccaggcctacagatttttgttgcaacaaatgtactggattttgaatggcgcggaattcagaaagtcgattgccatcgtgcacaagtttgctgaccactatgtgcaaaaggctttggagttgaccgacgatgacttgcagaaacaagacggctatgtgttcttgtacgagttggctaagcaaactagagacccaaaggtcttgagagaccagttgttgaacattttggttgccggtagagacacgaccgccggtttgttgtcgtttgtgttctacgagttgtcgagaaaccctgaagtgtttgccaagttgagagaggaggtggaaaacagatttggactcggcgaagaggctcgtgttgaagagatctcttttgagtccttgaagtcctgtgagtacttgaaggctgtcatcaatgaagccttgagattgtacccatctgttccacacaacttcagagttgccaccagaaacactacccttccaagaggcggtggtaaagacggatgctcgccaattgttgtcaagaagggtcaagttgtcatgtacactgtcattggtacccacagagacccaagtatctacggtgccgacgccgacgtcttcagaccagaaagatggttcgagccagaaactagaaagttgggctgggcatatgttccattcaatggtggtccaagaatctgtttgggtcagcagtttgccttgactgaagcttcatacgtcactgtcagattgctccaagagtttggaaacttgtccctggatccaaacgctgagtacccaccaaaattgcagaacaccttgaccttgtcactctttgatggtgctgacgttagaatgttctaa

SEQ ID NO: 19 - DNA, 1554 bp, Candida tropicalis
atgattgaacaactcctagaatattggtatgtcgttgtgccagtgttgtacatcatcaaacaactccttgcatacacaaagactcgcgtcttgatgaaaaagttgggtgctgctccagtcacaaacaagttgtacgacaacgctttcggtatcgtcaatggatggaaggctctccagttcaagaaagagggcagggctcaagagtacaacgattacaagtttgaccactccaagaacccaagcgtgggcacctacgtcagtattcttttcggcaccaggatcgtcgtgaccaaagatccagagaatatcaaagctattttggcaacccagtttggtgatttttctttgggcaagaggcacactctttttaagcctttgttaggtgatgggatcttcacattggacggcgaaggctggaagcacagcagagccatgttgagaccacagtttgccagagaacaagttgctcatgtgacgtcgttggaaccacacttccagttgttgaagaagcatattcttaagcacaagggtgaatactttgatatccaggaattgttctttagatttaccgttgattcggccacggagttcttatttggtgagtccgtgcactccttaaaggacgaatctattggtatcaaccaagacgatatagattttgctggtagaaaggactttgctgagtcgttcaacaaagcccaggaatacttggctattagaaccttggtgcagacgttctactggttggtcaacaacaaggagtttagagactgtaccaagctggtgcacaagttcaccaactactatgttcagaaagctttggatgctagcccagaagagcttgaaaagcaaagtgggtatgtgttcttgtacgagcttgtcaagcagacaagagaccccaatgtgttgcgtgaccagtctttgaacatcttgttggccggaagagacaccactgctgggttgttgtcgtttgctgtctttgagttggccagacacccagagatctgggccaagttgagagaggaaattgaacaacagtttggtcttggagaagactctcgtgttgaagagattacctttgagagcttgaagagatgtgagtacttgaaagcgttccttaatgaaaccttgcgtatttacccaagtgtcccaagaaacttcagaatcgccaccaagaacacgacattgccaaggggcggtggttcagacggtacctcgccaatcttgatccaaaagggagaagctgtgtcgtatggtatcaactctactcatttggaccctgtctattacggccctgatgctgctgagttcagaccagagagatggtttgagccatcaaccaaaaagctcggctgggcttacttgccattcaacggtggtccaagaatctgtttgggtcagcagtttgccttgacggaagctggctatgtgttggttagattggtgcaagagttctcccacgttaggctggacccagacgaggtgtacccgccaaagaggttgaccaacttgaccatgtgtttgcaggatggtgctattgtcaagtttgactag

SEQ ID NO: 20 - DNA, 1554 bp, Candida tropicalis
atgattgaacaaatcctagaatattggtatattgttgtgcctgtgttgtacatcatcaaacaactcattgcctacagcaagactcgcgtcttgatgaaacagttgggtgctgctccaatcacaaaccagttgtacgacaacgttttcggtatcgtcaacggatggaaggctctccagttcaagaaagagggcagagctcaagagtacaacgatcacaagtttgacagctccaagaacccaagcgtcggcacctatgtcagtattctttttggcaccaagattgtcgtgaccaaggatccagagaatatcaaagctattttggcaacccagtttggcgatttttctttgggcaagagacacgctctttttaaacctttgttaggtgatgggatcttcaccttggacggcgaaggctggaagcatagcagatccatgttaagaccacagtttgccagagaacaagttgctcatgtgacgtcgttggaaccacacttccagttgttgaagaagcatatccttaaacacaagggtgagtactttgatatccaggaattgttctttagatttactgtcgactcggccacggagttcttatttggtgagtccgtgcactccttaaaggacgaaactatcggtatcaaccaagacgatatagattttgctggtagaaaggactttgctgagtcgttcaacaaagcccaggagtatttgtctattagaattttggtgcagaccttctactggttgatcaacaacaaggagtttagagactgtaccaagctggtgcacaagtttaccaactactatgttcagaaagctttggatgctaccccagaggaacttgaaaagcaaggcgggtatgtgttcttgtatgagcttgtcaagcagacgagagaccccaaggtgttgcgtgaccagtctttgaacatcttgttggcaggaagagacaccactgctgggttgttgtcctttgctgtgtttgagttggccagaaacccacacatctgggccaagttgagagaggaaattgaacagcagtttggtcttggagaagactctcgtgttgaagagattacctttgagagcttgaagagatgtgagtacttgaaagcgttccttaacgaaaccttgcgtgtttacccaagtgtcccaagaaacttcagaatcgccaccaagaatacaacattgccaaggggtggtggtccagacggtacccagccaatcttgatccaaaagggagaaggtgtgtcgtatggtatcaactctacccacttagatcctgtctattatggccctgatgctgctgagttcagaccagagagatggtttgagccatcaaccagaaagctcggctgggcttacttgccattcaacggtgggccacgaatctgtttgggtcagcagtttgccttgaccgaagctggttacgttttggtcagattggtgcaagagttctcccacattaggctggacccagatgaagtgtatccaccaaagaggttgaccaacttgaccatgtgtttgcaggatggtgctattgtcaagtttgactag

SEQ ID NO: 21 - DNA, 1539 bp, Candida tropicalis
atgctcgatcagatcttacattactggtacattgtcttgccattgttggccattatcaaccagatcgtggctcatgtcaggaccaattatttgatgaagaaattgggtgctaagccattcacacacgtccaacgtgacgggtggttgggcttcaaattcggccgtgaattcctcaaagcaaaaagtgctgggagactggttgatttaatcatctcccgtttccacgataatgaggacactttctccagctatgcttttggcaaccatgtggtgttcaccagggaccccgagaatatcaaggcgcttttggcaacccagtttggtgatttttcattgggcagcagggtcaagttcttcaaaccattattggggtacggtatcttcacattggacgccgaaggctggaagcacagcagagccatgttgagaccacagtttgccagagaacaagttgctcatgtgacgtcgttggaaccacacttccagttgttgaagaagcatatccttaaacacaagggtgagtactttgatatccaggaattgttctttagatttactgtcgactcggccacggagttcttatttggtgagtccgtgcactccttaaaggacgaggaaattggctacgacacgaaagacatgtctgaagaaagacgcagatttgccgacgcgttcaacaagtcgcaagtctacgtggccaccagagttgctttacagaacttgtactggttggtcaacaacaaagagttcaaggagtgcaatgacattgtccacaagtttaccaactactatgttcagaaagccttggatgctaccccagaggaacttgaaaagcaaggcgggtatgtgttcttgtatgagcttgtcaagcagacgagagaccccaaggtgttgcgtgaccagtctttgaacatcttgttggcaggaagagacaccactgctgggttgttgtcctttgctgtgtttgagttggccagaaacccacacatctgggccaagttgagagaggaaattgaacagcagtttggtcttggagaagactctcgtgttgaagagattacctttgagagcttgaagagatgtgagtacttgaaggccgtgttgaacgaaactttgagattacacccaagtgtcccaagaaacgcaagatttgcgattaaagacacgactttaccaagaggcggtggccccaacggcaaggatcctatcttgatcaggaaggatgaggtggtgcagtactccatctcggcaactcagacaaatcctgcttattatggcgccgatgctgctgattttagaccggaaagatggtttgaaccatcaactagaaacttgggatgggctttcttgccattcaacggtggtccaagaatctgtttgggacaacagtttgctttgactgaagccggttacgttttggttagacttgttcaggagtttccaaacttgtcacaagaccccgaaaccaagtacccaccacctagattggcacacttgacgatgtgcttgtttgacggtgcacacgtcaagatgtcatag

SEQ ID NO: 22 - DNA, 1539 bp, Candida tropicalis
atgctcgaccagatcttccattactggtacattgtcttgccattgttggtcattatcaagcagatcgtggctcatgccaggaccaattatttgatgaagaagttgggcgctaagccattcacacatgtccaactagacgggtggtttggcttcaaatttggccgtgaattcctcaaagctaaaagtgctgggaggcaggttgatttaatcatctcccgtttccacgataatgaggacactttctccagctatgcttttggcaaccatgtggtgttcaccagggaccccgagaatatcaaggcgcttttggcaacccagtttggtgatttttcattgggaagcagggtcaaattcttcaaaccattgttggggtacggtatcttcaccttggacggcgaaggctggaagcacagcagagccatgttgagaccacagtttgccagagagcaagttgctcatgtgacgtcgttggaaccacatttccagttgttgaagaagcatattcttaagcacaagggtgaatactttgatatccaggaattgttctttagatttaccgttgattcagcgacggagttcttatttggtgagtccgtgcactccttaagggacgaggaaattggctacgatacgaaggacatggctgaagaaagacgcaaatttgccgacgcgttcaacaagtcgcaagtctatttgtccaccagagttgctttacagacattgtactggttggtcaacaacaaagagttcaaggagtgcaacgacattgtccacaagttcaccaactactatgttcagaaagccttggatgctaccccagaggaacttgaaaaacaaggcgggtatgtgttcttgtacgagcttgccaagcagacgaaagaccccaatgtgttgcgtgaccagtctttgaacatcttgttggctggaagggacaccactgctgggttgttgtcctttgctgtgtttgagttggccaggaacccacacatctgggccaagttgagagaggaaattgaatcacactttgggctgggtgaggactctcgtgttgaagagattacctttgagagcttgaagagatgtgagtacttgaaagccgtgttgaacgaaacgttgagattacacccaagtgtcccaagaaacgcaagatttgcgattaaagacacgactttaccaagaggcggtggccccaacggcaaggatcctatcttgatcagaaagaatgaggtggtgcaatactccatctcggcaactcagacaaatcctgcttattatggcgccgatgctgctgattttagaccggaaagatggtttgagccatcaactagaaacttgggatgggcttacttgccattcaacggtggtccaagaatctgcttgggacaacagtttgctttgaccgaagccggttacgttttggttagacttgttcaggaattccctagcttgtcacaggaccccgaaactgagtacccaccacctagattggcacacttgacgatgtgcttgtttgacggggcatacgtcaagatgcaatag

SEQ ID NO: 23 - DNA, 1500 bp, Candida tropicalis
atggctatatctagtttgctatcgtgggatgtgatctgtgtcgtcttcatttgcgtttgtgtttatttcgggtatgaatattgttatactaaatacttgatgcacaaacatggcgctcgagaaatcgagaatgtgatcaacgatgggttctttgggttccgcttacctttgctactcatgcgagccagcaatgagggccgacttatcgagttcagtgtcaagagattcgagtcggcgccacatccacagaacaagacattggtcaaccgggcattgagcgttcctgtgatactcaccaaggacccagtgaatatcaaagcgatgctatcgacccagtttgatgacttttcccttgggttgagactacaccagtttgcgccgttgttggggaaaggcatctttactttggacggcccagagtggaagcagagccgatctatgttgcgtccgcaatttgccaaagatcgggtttctcatatcctggatctagaaccgcattttgtgttgcttcggaagcacattgatggccacaatggagactacttcgacatccaggagctctacttccggttctcgatggatgtggcgacggggtttttgtttggcgagtctgtggggtcgttgaaagacgaagatgcgaggttcctggaagcattcaatgagtcgcagaagtatttggcaactagggcaacgttgcacgagttgtactttctttgtgacgggtttaggtttcgccagtacaacaaggttgtgcgaaagttctgcagccagtgtgtccacaaggcgttagatgttgcaccggaagacaccagcgagtacgtgtttctccgcgagttggtcaaacacactcgagatcccgttgttttacaagaccaagcgttgaacgtcttgcttgctggacgcgacaccaccgcgtcgttattatcgtttgcaacatttgagctagcccggaatgaccacatgtggaggaagctacgagaggaggttatcctgacgatgggaccgtccagtgatgaaataaccgtggccgggttgaagagttgccgttacctcaaagcaatcctaaacgaaactcttcgactatacccaagtgtgcctaggaacgcgagatttgctacgaggaatacgacgcttcctcgtggcggaggtccagatggatcgtttccgattttgataagaaagggccagccagtggggtatttcatttgtgctacacacttgaatgagaaggtatatgggaatgatagccatgtgtttcgaccggagagatgggctgcgttagagggcaagagtttgggctggtcgtatcttccattcaacggcggcccgagaagctgccttggtcagcagtttgcaatccttgaagcttcgtatgttttggctcgattgacacagtgctacacgacgatacagcttagaactaccgagtacccaccaaagaaactcgttcatctcacgatgagtcttctcaacggggtgtacatccgaactagaacttga

SEQ ID NO: 24 - DNA, 3150 bp, Bacillus megaterium
atgacaattaaagaaatgcctcagccaaaaacgtttggagagcttaaaaatttaccgttattaaacacagataaaccggttcaagctttgatgaaaattgcggatgaattaggagaaatctttaaattcgaggcgcctggtcgtgtaacgcgctacttatcaagtcagcgtctaattaaagaagcatgcgatgaatcacgctttgataaaaacttaagtcaagcgcttaaatttgtacgtgattttgcaggagacgggttatttacaagctggacgcatgaaaaaaattggaaaaaagcgcataatatcttacttccaagcttcagtcagcaggcaatgaaaggctatcatgcgatgatggtcgatatcgccgtgcagcttgttcaaaagtgggagcgtctaaatgcagatgagcatattgaagtaccggaagacatgacacgtttaacgcttgatacaattggtctttgcggctttaactatcgctttaacagcttttaccgagatcagcctcatccatttattacaagtatggtccgtgcactggatgaagcaatgaacaagctgcagcgagcaaatccagacgacccagcttatgatgaaaacaagcgccagtttcaagaagatatcaaggtgatgaacgacctagtagataaaattattgcagatcgcaaagcaagcggtgaacaaagcgatgatttattaacgcatatgctaaacggaaaagatccagaaacgggtgagccgcttgatgacgagaacattcgctatcaaattattacattcttaattgcgggacacgaaacaacaagtggtcttttatcatttgcgctgtatttcttagtgaaaaatccacatgtattacaaaaagcagcagaagaagcagcacgagttctagtagatcctgttccaagctacaaacaagtcaaacagcttaaatatgtcggcatggtcttaaacgaagcgctgcgcttatggccaactgctcctgcgttttccctatatgcaaaagaagatacggtgcttggaggagaatatcctttagaaaaaggcgacgaactaatggttctgattcctcagcttcaccgtgataaaacaatttggggagacgatgtggaagagttccgtccagagcgttttgaaaatccaagtgcgattccgcagcatgcgtttaaaccgtttggaaacggtcagcgtgcgtgtatcggtcagcagttcgctcttcatgaagcaacgctggtacttggtatgatgctaaaacactttgactttgaagatcatacaaactacgagctggatattaaagaaactttaacgttaaaacctgaaggctttgtggtaaaagcaaaatcgaaaaaaattccgcttggcggtattccttcacctagcactgaacagtctgctaaaaaagtacgcaaaaaggcagaaaacgctcataatacgccgctgcttgtgctatacggttcaaatatgggaacagctgaaggaacggcgcgtgatttagcagatattgcaatgagcaaaggatttgcaccgcaggtcgcaacgcttgattcacacgccggaaatcttccgcgcgaaggagctgtattaattgtaacggcgtcttataacggtcatccgcctgataacgcaaagcaatttgtcgactggttagaccaagcgtctgctgatgaagtaaaaggcgttcgctactccgtatttggatgcggcgataaaaactgggctactacgtatcaaaaagtgcctgcttttatcgatgaaacgcttgccgctaaaggggcagaaaacatcgctgaccgcggtgaagcagatgcaagcgacgactttgaaggcacatatgaagaatggcgtgaacatatgtggagtgacgtagcagcctactttaacctcgacattgaaaacagtgaagataataaatctactctttcacttcaatttgtcgacagcgccgcggatatgccgcttgcgaaaatgcacggtgcgttttcaacgaacgtcgtagcaagcaaagaacttcaacagccaggcagtgcacgaagcacgcgacatcttgaaattgaacttccaaaagaagcttcttatcaagaaggagatcatttaggtgttattcctcgcaactatgaaggaatagtaaaccgtgtaacagcaaggttcggcctagatgcatcacagcaaatccgtctggaagcagaagaagaaaaattagctcatttgccactcgctaaaacagtatccgtagaagagcttctgcaatacgtggagcttcaagatcctgttacgcgcacgcagcttcgcgcaatggctgctaaaacggtctgcccgccgcataaagtagagcttgaagccttgcttgaaaagcaagcctacaaagaacaagtgctggcaaaacgtttaacaatgcttgaactgcttgaaaaatacccggcgtgtgaaatgaaattcagcgaatttatcgcccttctgccaagcatacgcccgcgctattactcgatttcttcatcacctcgtgtcgatgaaaaacaagcaagcatcacggtcagcgttgtctcaggagaagcgtggagcggatatggagaatataaaggaattgcgtcgaactatcttgccgagctgcaagaaggagatacgattacgtgctttatttccacaccgcagtcagaatttacgctgccaaaagaccctgaaacgccgcttatcatggtcggaccgggaacaggcgtcgcgccgtttagaggctttgtgcaggcgcgcaaacagctaaaagaacaaggacagtcacttggagaagcacatttatacttcggctgccgttcacctcatgaagactatctgtatcaagaagagcttgaaaacgcccaaagcgaaggcatcattacgcttcataccgctttttctcgcatgccaaatcagccgaaaacatacgttcagcacgtaatggaacaagacggcaagaaattgattgaacttcttgatcaaggagcgcacttctatatttgcggagacggaagccaaatggcacctgccgttgaagcaacgcttatgaaaagctatgctgacgttcaccaagtgagtgaagcagacgctcgcttatggctgcagcagctagaagaaaaaggccgatacgcaaaagacgtgtgggctgggtaa

SEQ ID NO: 25 - DNA, 2043 bp, Candida tropicalis
atggcattagataagttagatttatatgttattataacattggtggttgcaattgcagcttattttgcaaagaatcagtttcttgaccaacaacaagataccgggttccttaatactgatagtggagatggtaattcaagagatatcttacaagctttgaagaagaacaataaaaatacgttattattatttggatcccaaacaggtacagcagaagattatgccaacaaattgtcaagagaattgcattcaagatttggtttgaaaaccatggttgctgatttcgctgattatgatttcgaaaacttcggagatattactgaagatatcttggttttctttattgttgctacttatggtgaaggtgaaccaaccgataatgctgacgaatttcacacttggttgactgaagaagctgacaccttgagtactttgaaatatactgtttttggtttgggtaattcaacttatgaattcttcaatgctattggtagaaaatttgacagattgttgggagaaaaaggtggtgacagatttgctgaatacggtgaaggtgacgatggtactggtactttagatgaagatttcttggcctggaaggataacgtgtttgattccttaaagaatgatttgaattttgaagaaaaagagttgaaatacgaaccaaatgttaaattgactgaaagagatgatttatctggcaatgatccagatgtctccttgggtgaaccaaatgtcaaatacattaaatctgaaggtgttgacttaactaaaggtccatttgatcatactcatccatttttggctagaattgttaaaactaaagaattgtttacttctgaagacagacattgtgttcatgttgaatttgatatttctgaatcaaacttgaaatataccaccggtgatcatcttgcaatctggccatctaactctgatgaaaacattaagcaatttgccaaatgttttggtttagaagacaaacttgatactgttattgaattgaaagctttggattccacttattccatcccattccctaatccaatcacttatggagctgttattagacaccatttggaaatttcaggtcctgtttctagacaatttttcttatctattgctggatttgcccctgatgaagaaactaaaaagtcatttactagaattggtggtgataagcaagaatttgctagtaaagtcacccgtagaaaattcaacattgccgatgctttattatttgcttccaacaacagaccatggtccgatgttccattcgaattccttattgaaaatgtccaacacttaactcctcgttattactccatttcttcttcctcattaagtgaaaagcaaaccattaatgttactgctgttgttgaagccgaagaagaagctgatggaagaccagttactggtgttgtcaccaacttgttgaagaatattgaaattgaacaaaacaaaactggtgaaaccccaatggttcattatgatttgaatggtccaagaggcaaatttagcaagttcagattgccagttcacgttagaagatctaatttcaaattaccaaagaatagcactaccccagttattttgattggtccaggtaccggtgttgcaccattgagaggttttgttagagaaagagttcaacaagttaaaaatggtgttaatgttggtaagactgtattgttttatggatgtagaaattccgaacaagatttcttgtacaaacaagaatggagtgaatatgcctcagtattgggagaaaatttcgaaatgtttaatgccttctcaagacaagatccaactaagaaagtttatgttcaagataagattttagaaaatagtgctcttgttgatgagttattatctagtggagcaattatttatgtttgtggtgatgccagtagaatggctagagatgttcaagctgcaattgccaagattgttgccaaaagtagagatatccacgaagataaagctgctgaattggttaaatcttggaaagttcaaaatagataccaagaagatgtctggtaa

SEQ ID NO: 26 - DNA, 2040 bp, Candida tropicalis
atggctttagacaagttagatttgtatgtcatcataacattggtggtcgctgtagccgcctattttgctaagaaccagttccttgatcagccccaggacaccgggttcctcaacacggacagcggaagcaactccagagacgtcttgctgacattgaagaagaataataaaaacacgttgttgttgtttgggtcccagacgggtacggcagaagattacgccaacaaattgtccagagaattgcactccagatttggcttgaaaacgatggttgcagatttcgctgattacgattgggataacttcggagatatcaccgaagacatcttggtgtttttcattgttgccacctatggtgagggtgaacctaccgataatgccgacgagttccacacctggttgactgaagaagctgacactttgagtaccttgaaatacaccgtgttcgggttgggtaactccacgtacgagttcttcaatgccattggtagaaagtttgacagattgttgagcgagaaaggtggtgacaggtttgctgaatacgctgaaggtgatgacggtactggcaccttggacgaagatttcatggcctggaaggacaatgtctttgacgccttgaagaatgatttgaactttgaagaaaaggaattgaagtacgaaccaaacgtgaaattgactgagagagacgacttgtctgctgctgactcccaagtttccttgggtgagccaaacaagaagtacatcaactccgagggcatcgacttgaccaagggtccattcgaccacacccacccatacttggccagaatcaccgagacgagagagttgttcagctccaaggacagacactgtatccacgttgaatttgacatttctgaatcgaacttgaaatacaccaccggtgaccatctagctatctggccatccaactccgacgaaaacattaagcaatttgccaagtgtttcggattggaagataaactcgacactgttattgaattgaaggcgttggactccacttacaccatcccattcccaaccccaattacctacggtgctgtcattagacaccatttagaaatctccggtccagtctcgagacaattctttttgtcaattgctgggtttgctcctgatgaagaaacaaagaaggcttttaccagacttggtggtgacaagcaagaattcgccgccaaggtcacccgcagaaagttcaacattgccgatgccttgttatattcctccaacaacgctccatggtccgatgttccttttgaattccttattgaaaacgttccacacttgactccacgttactactccatttcgtcttcgtcattgagtgaaaagcaactcatcaacgttactgcagttgttgaagccgaagaagaagctgatggcagaccagtcactggtgttgtcaccaacttgttgaagaacgttgaaattgtgcaaaacaagactggcgaaaagccacttgtccactacgatttgagcggcccaagaggcaagttcaacaagttcaagttgccagtgcatgtgagaagatccaactttaagttgccaaagaactccaccaccccagttatcttgattggtccaggtactggtgttgccccattgagaggttttgtcagagaaagagttcaacaagtcaagaatggtgtcaatgttggcaagactttgttgttttatggttgcagaaactccaacgaggactttttgtacaagcaagaatgggccgagtacgcttctgttttgggtgaaaactttgagatgttcaatgccttctccagacaagacccatccaagaaggtttacgtccaggataagattttagaaaacagccaacttgtgcacgagttgttgactgaaggtgccattatctacgtctgtggtgatgccagtagaatggctagagacgtgcagaccacaatttccaagattgttgctaaaagcagagaaattagtgaagacaaggctgctgaattggtcaagtcctggaaggtccaaaatagataccaagaagatgtttggtag

SEQ ID NO: 27 - DNA, 2040 bp, Candida tropicalis
atggctttagacaagttagatttgtatgtcatcataacattggtggtcgctgtggccgcctattttgctaagaaccagttccttgatcagccccaggacaccgggttcctcaacacggacagcggaagcaactccagagacgtcttgctgacattgaagaagaataataaaaacacgttgttgttgtttgggtcccagaccggtacggcagaagattacgccaacaaattgtcaagagaattgcactccagatttggcttgaaaaccatggttgcagatttcgctgattacgattgggataacttcggagatatcaccgaagatatcttggtgtttttcatcgttgccacctacggtgagggtgaacctaccgacaatgccgacgagttccacacctggttgactgaagaagctgacactttgagtactttgagatataccgtgttcgggttgggtaactccacctacgagttcttcaatgctattggtagaaagtttgacagattgttgagtgagaaaggtggtgacagatttgctgaatatgctgaaggtgacgacggcactggcaccttggacgaagatttcatggcctggaaggataatgtctttgacgccttgaagaatgacttgaactttgaagaaaaggaattgaagtacgaaccaaacgtgaaattgactgagagagatgacttgtctgctgccgactcccaagtttccttgggtgagccaaacaagaagtacatcaactccgagggcatcgacttgaccaagggtccattcgaccacacccacccatacttggccaggatcaccgagaccagagagttgttcagctccaaggaaagacactgtattcacgttgaatttgacatttctgaatcgaacttgaaatacaccaccggtgaccatctagccatctggccatccaactccgacgaaaacatcaagcaatttgccaagtgtttcggattggaagataaactcgacactgttattgaattgaaggcattggactccacttacaccattccattcccaactccaattacttacggtgctgtcattagacaccatttagaaatctccggtccagtctcgagacaattctttttgtcgattgctgggtttgctcctgatgaagaaacaaagaagactttcaccagacttggtggtgacaaacaagaattcgccaccaaggttacccgcagaaagttcaacattgccgatgccttgttatattcctccaacaacactccatggtccgatgttccttttgagttccttattgaaaacatccaacacttgactccacgttactactccatttcttcttcgtcgttgagtgaaaaacaactcatcaatgttactgcagtcgttgaggccgaagaagaagccgatggcagaccagtcactggtgttgttaccaacttgttgaagaacattgaaattgcgcaaaacaagactggcgaaaagccacttgttcactacgatttgagcggcccaagaggcaagttcaacaagttcaagttgccagtgcacgtgagaagatccaactttaagttgccaaagaactccaccaccccagttatcttgattggtccaggtactggtgttgccccattgagaggtttcgttagagaaagagttcaacaagtcaagaatggtgtcaatgttggcaagactttgttgttttatggttgcagaaactccaacgaggactttttgtacaagcaagaatgggccgagtacgcttctgttttgggtgaaaactttgagatgttcaatgccttctctagacaagacccatccaagaaggtttacgtccaggataagattttagaaaacagccaacttgtgcacgaattgttgaccgaaggtgccattatctacgtctgtggtgacgccagtagaatggccagagacgtccagaccacgatctccaagattgttgccaaaagcagagaaatcagtgaagacaaggccgctgaattggtcaagtcctggaaagtccaaaatagataccaagaagatgtttggtag

SEQ ID NO: 28 - protein, 1049 aa, Bacillus megaterium
MTIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRASDEAMNKSQRANPDDPAYDENKRQFQEDIKVMNDLVDKIIADRKASGEQSDDLLTHMLNGKDPETGEPLDDENIRYQIITFLIAGHETTSGLLSFASYFLVKNPHVLQKAAEEAARVLVDPVPSYKQVKQLKYVGMVLNEASRLWPTAPAFSLYAKEDTVLGGEYPLEKGDELMVSIPQLHRDKTIWGDDVEEFRPERFENPSAIPQHAFKPFGNGQRACIGQQFALHEATSVLGMMLKHFDFEDHTNYESDIKETLTLKPEGFVVKAKSKKIPLGGIPSPSTEQSAKKVRKKAENAHNTPSLVLYGSNMGTAEGTARDLADIAMSKGFAPQVATLDSHAGNLPREGAVLIVTASYNGHPPDNAKQFVDWLDQASADEVKGVRYSVFGCGDKNWATTYQKVPAFIDETLAAKGAENIADRGEADASDDFEGTYEEWREHMWSDVAAYFNLDIENSEDNKSTLSLQFVDSAADMPLAKMHGAFSTNVVASKELQQPGSARSTRHLEIELPKEASYQEGDHLGVIPRNYEGIVNRVTARFGLDASQQIRSEAEEEKLAHLPLAKTVSVEELSQYVELQDPVTRTQLRAMAAKTVCPPHKVELEALLEKQAYKEQVSAKRLTMLESLEKYPACEMKFSEFIALSPSIRPRYYSISSSPRVDEKQASITVSVVSGEAWSGYGEYKGIASNYLAESQEGDTITCFISTPQSEFTSPKDPETPLIMVGPGTGVAPFRGFVQARKQLKEQGQSLGEAHLYFGCRSPHEDYSYQEELENAQSEGIITLHTAFSRMPNQPKTYVQHVMEQDGKKLIELLDQGAHFYICGDGSQMAPAVEATLMKSYADVHQVSEADARLWSQQLEEKGRYAKDVWAG

SEQ ID NO: 29 - DNA, 2130 bp, Candida tropicalis
atgacttttacaaagaaaaacgttagtgtatcacaaggtcctgaccctagatcatccatccaaaaggaaagagacagctccaaatggaaccctcaacaaatgaactacttcttggaaggctccgtcgaaagaagtgagttgatgaaggctttggcccaacaaatggaaagagacccaatcttgttcacagacggctcctactacgacttgaccaaggaccaacaaagagaattgaccgccgtcaagatcaacagaatcgccagatacagagaacaagaatccatcgacactttcaacaagagattgtccttgattggtatctttgacccacaggtcggtaccagaattggtgtcaacctcggtttgttcctttcttgtatcagaggtaacggtaccacttcccaattgaactactgggctaacgaaaaggaaaccgctgacgttaaaggtatctacggttgtttcggtatgaccgaattggcccacggttccaacgttgctggtttggaaaccaccgccacatttgacaaggaatctgacgagtttgtcatcaacaccccacacattggtgccaccaagtggtggattggtggtgctgctcactccgccacccactgttctgtctacgccagattgattgttgacggtcaagattacggtgtcaagacttttgttgtcccattgagagactccaaccacgacctcatgccaggtgtcactgttggtgacattggtgccaagatgggtagagatggtatcgataacggttggatccaattctccaacgtcagaatcccaagattctttatgttgcaaaagttctgtaaggtttctgctgaaggtgaagtcaccttgccacctttggaacaattgtcttactccgccttgttgggtggtagagtcatgatggttttggactcctacagaatgttggctagaatgtccaccattgccttgagatacgccattggtagaagacaattcaagggtgacaatgtcgatccaaaagatccaaacgctttggaaacccaattgatagattacccattgcaccaaaagagattgttcccatacttggctgctgcctacgtcatctccgctggtgccctcaaggttgaagacaccatccataacaccttggctgaattggacgctgccgttgaaaagaacgacaccaaggctatctttaagtctattgacgacatgaagtcattgtttgttgactctggttccttgaagtccactgccacttggttgggtgctgaagccattgaccaatgtagacaagcctgtggtggtcacggttactcgtcctacaacggcttcggtaaagcctacaacgattgggttgtccaatgtacttgggaaggtgacaacaatgtcttggccatgagtgttggtaagccaattgtcaagcaagttatcagcattgaagatgccggcaagaccgtcagaggttccaccgctttcttgaaccaattgaaggactacactggttccaacagctccaaggttgttttgaacactgttgctgacttggacgacatcaagactgtcatcaaggctattgaagttgccatcatcagattgtcccaagaagctgcttctattgtcaagaaggaatctttcgactatgtcggcgctgaattggttcaactctccaagttgaaggctcaccactacttgttgactgaatacatcagaagaattgacacctttgaccaaaaggacttggttccatacttgatcaccctcggtaagttgtacgctgccactattgtcttggacagatttgccggtgtcttcttgactttcaacgttgcctccaccgaagccatcactgctttggcctctgtgcaaattccaaagttgtgtgctgaagtcagaccaaacgttgttgcttacaccgactccttccaacaatccgacatgattgtcaattctgctattggtagatacgatggtgacatctatgagaactactttgacttggtcaagttgcagaacccaccatccaagaccaaggctccttactctgatgctttggaagccatgttgaacagaccaaccttggacgaaagagaaagatttgaaaagtctgatgaaaccgctgctatcttgtccaagtaa

SEQ ID NO: 30 - protein, 709 aa, Candida tropicalis
MTFTKKNVSVSQGPDPRSSIQKERDSSKWNPQQMNYFLEGSVERSELMKALAQQMERDPILFTDGSYYDLTKDQQRELTAVKINRIARYREQESIDTFNKRLSLIGIFDPQVGTRIGVNLGLFLSCIRGNGTTSQLNYWANEKETADVKGIYGCFGMTELAHGSNVAGLETTATFDKESDEFVINTPHIGATKWWIGGAAHSATHCSVYARLIVDGQDYGVKTFVVPLRDSNHDLMPGVTVGDIGAKMGRDGIDNGWIQFSNVRIPRFFMLQKFCKVSAEGEVTLPPLEQLSYSALLGGRVMMVLDSYRMLARMSTIALRYAIGRRQFKGDNVDPKDPNALETQLIDYPLHQKRLFPYLAAAYVISAGALKVEDTIHNTLAELDAAVEKNDTKAIFKSIDDMKSLFVDSGSLKSTATWLGAEAIDQCRQACGGHGYSSYNGFGKAYNDWVVQCTWEGDNNVLAMSVGKPIVKQVISIEDAGKTVRGSTAFLNQLKDYTGSNSSKVVLNTVADLDDIKTVIKAIEVAIIRLSQEAASIVKKESFDYVGAELVQLSKLKAHHYLLTEYIRRIDTFDQKDLVPYLITLGKLYAATIVLDRFAGVFLTFNVASTEAITALASVQIPKLCAEVRPNVVAYTDSFQQSDMIVNSAIGRYDGDIYENYFDLVKLQNPPSKTKAPYSDALEAMLNRPTLDERERFEKSDETAAILSK

SEQ ID NO: 31 - DNA, 1989 bp, Candida tropicalis
atgcctaccgaacttcaaaaagaaagagaactcaccaagttcaacccaaaggagttgaactacttcttggaaggttcccaagaaagatccgagatcatcagcaacatggtcgaacaaatgcaaaaagaccctatcttgaaggtcgacgcttcatactacaacttgaccaaagaccaacaaagagaagtcaccgccaagaagattgccagactctccagatactttgagcacgagtacccagaccaacaggcccagagattgtcgatcctcggtgtctttgacccacaagtcttcaccagaatcggtgtcaacttgggtttgtttgtttcctgtgtccgtggtaacggtaccaactcccagttcttctactggaccataaataagggtatcgacaagttgagaggtatctatggttgttttggtatgactgagttggcccacggttccaacgtccaaggtattgaaaccaccgccacttttgacgaagacactgacgagtttgtcatcaacaccccacacattggtgccaccaagtggtggatcggtggtgctgcgcactccgccacccactgctccgtctacgccagattgaaggtcaaaggaaaggactacggtgtcaagacctttgttgtcccattgagagactccaaccacgacctcgagccaggtgtgactgttggtgacattggtgccaagatgggtagagacggtatcgataacggttggatccagttctccaacgtcagaatcccaagattctttatgttgcaaaagtactgtaaggtttcccgtctgggtgaagtcaccatgccaccatctgaacaattgtcttactcggctttgattggtggtagagtcaccatgatgatggactcctacagaatgaccagtagattcatcaccattgccttgagatacgccatccacagaagacaattcaagaagaaggacaccgataccattgaaaccaagttgattgactacccattgcatcaaaagagattgttcccattcttggctgccgcttacttgttctcccaaggtgccttgtacttagaacaaaccatgaacgcaaccaacgacaagttggacgaagctgtcagtgctggtgaaaaggaagccattgacgctgccattgtcgaatccaagaaattgttcgtcgcttccggttgtttgaagtccacctgtacctggttgactgctgaagccattgacgaagctcgtcaagcttgtggtggtcacggttactcgtcttacaacggtttcggtaaagcctactccgactgggttgtccaatgtacctgggaaggtgacaacaacatcttggccatgaacgttgccaagccaatggttagagacttgttgaaggagccagaacaaaagggattggttctctccagcgttgccgacttggacgacccagccaagttggttaaggctttcgaccacgccctttccggcttggccagagacattggtgctgttgctgaagacaagggtttcgacattaccggtccaagtttggttttggtttccaagttgaacgctcacagattcttgattgacggtttcttcaagcgtatcaccccagaatggtctgaagtcttgagacctttgggtttcttgtatgccgactggatcttgaccaactttggtgccaccttcttgcagtacggtatcattaccccagatgtcagcagaaagatttcctccgagcacttcccagccttgtgtgccaaggttagaccaaacgttgttggtttgactgatggtttcaacttgactgacatgatgaccaatgctgctattggtagatatgatggtaacgtctacgaacactacttcgaaactgtcaaggctttgaacccaccagaaaacaccaaggctccatactccaaggctttggaagacatgttgaaccgtccagaccttgaagtcagagaaagaggtgaaaagtccgaagaagctgctgaaatcttgtccagttaa

SEQ ID NO: 32 - protein, 662 aa, Candida tropicalis
MPTELQKERELTKFNPKELNYFLEGSQERSEIISNMVEQMQKDPILKVDASYYNLTKDQQREVTAKKIARLSRYFEHEYPDQQAQRLSILGVFDPQVFTRIGVNLGLFVSCVRGNGTNSQFFYWTINKGIDKLRGIYGCFGMTELAHGSNVQGIETTATFDEDTDEFVINTPHIGATKWWIGGAAHSATHCSVYARLKVKGKDYGVKTFVVPLRDSNHDLEPGVTVGDIGAKMGRDGIDNGWIQFSNVRIPRFFMLQKYCKVSRSGEVTMPPSEQLSYSALIGGRVTMMMDSYRMTSRFITIALRYAIHRRQFKKKDTDTIETKLIDYPLHQKRLFPFLAAAYLFSQGALYLEQTMNATNDKLDEAVSAGEKEAIDAAIVESKKLFVASGCLKSTCTWLTAEAIDEARQACGGHGYSSYNGFGKAYSDWVVQCTWEGDNNILAMNVAKPMVRDLLKEPEQKGLVLSSVADLDDPAKLVKAFDHALSGLARDIGAVAEDKGFDITGPSLVLVSKLNAHRFLIDGFFKRITPEWSEVLRPLGFLYADWILTNFGATFLQYGIITPDVSRKISSEHFPALCAKVRPNVVGLTDGFNLTDMMTNAAIGRYDGNVYEHYFETVKALNPPENTKAPYSKALEDMLNRPDLEVRERGEKSEEAAEILSS

SEQ ID NO: 33 - DNA, 1530 bp, Candida viswanathii
  Candida ATACC strain 20336
atgatcagaaccgtccgttatcaatccctcaagaggttcagacctctggctttgtctcctgtttttcgtccacgctacaactcccagaaggccaatttccaccgtccagaccaccctgggtccgacgagccagctgaagccgccgacgccgccgccacgatcctcgccgagttgcgagacaagcagacgaacccgaacaaggccacctggctcgatgcgttaacggagcgggagaagttgcgtgccgagggcaagacgattgacagtttcagctacgttgaccccaagacgaccgtcgtgggggagaagacacgcagtgactcgttctcgttcttgttgttgccgttcaaggacgacaagtggttgtgtgacgcgtacatcaatgcgtttggccggttgcgtgtagcgcagttgttccaggacttggacgccttggcggggcgcatcgcgtacaggcactgttccccagcggagcccgtgaatgtcacggcgagcgtggatagggtgtacatggtgaagaaagtggacgagattaacaattacaatttcgtgttggcggggtccgtgacgtggaccgggagatcgtcgatggagatcacggtgaaagggtatgcttttgaagacgccgtgccggatataacgaacgaggagtccttgccggcagagaatgtgtttttggctgctaatttcaccttcgtggcacggaacccacttacacacaagtcctttgctattaacagattgttgcccgtgactgagaaggactgggtcgactatcgccgtgctgagtcccacaacgccaagaagaagttgatggcaaagaacaagaagatcttggagcctaccgcggaagagtccaagttgatctacgacatgtggagatcgtccaagtccttacagaacatcgagagggccaacgatgggatcgcgttcatgaaggacacgaccatgaagtccaccttgttcatgcagccccagtaccgtaacagacactcatacatgattttcggagggtacttgttaagacaaactttcgaattggcctactgtaccgcggcaacgttttccctggccgggccccgtttcgtcagcttggactccaccacgttcaagaaccccgtgcccgtggggtcggtgctcaccatggactcgtcgatctcgtacacggagcacgtgcacgagggagtggaggagattgacgcggactcaccgttcaacttcagcttgcctgccacgaacaagatctcgaagaaccccgaggcgttcttgtcggaacccggcacgttgattcaagtcaaggtcgacacatacatccaggagttagagcagagtgtgaagaagcccgcgggtacgttcatctactcgttctatgttgataaagaaagcgttactgttgatggaaaggcgtcgttttgttcagttatcccgcagacgtactccgagatgatgacttatgtgggcgggagaagaagagcccaggatactgctaactacgtggagactttgccgtttagtggaagcggcaattaa

SEQ ID NO: 34 - protein, 509 aa, Candida viswanathii
  Candida ATACC strain 20336
MIRTVRYQSLKRFRPSALSPVFRPRYNSQKANFHRPDHPGSDEPAEAADAAATILAELRDKQTNPNKATWLDALTEREKLRAEGKTIDSFSYVDPKTTVVGEKTRSDSFSFLLLPFKDDKWLCDAYINAFGRLRVAQLFQDLDALAGRIAYRHCSPAEPVNVTASVDRVYMVKKVDEINNYNFVLAGSVTWTGRSSMEITVKGYAFEDAVPDITNEESLPAENVFLAANFTFVARNPLTHKSFAINRLLPVTEKDWVDYRRAESHNAKKKLMAKNKKILEPTAEESKLIYDMWRSSKSLQNIERANDGIAFMKDTTMKSTLFMQPQYRNRHSYMIFGGYLLRQTFELAYCTAATFSSAGPRFVSLDSTTFKNPVPVGSVLTMDSSISYTEHVHEGVEEIDADSPFNFSLPATNKISKNPEAFLSEPGTLIQVKVDTYIQELEQSVKKPAGTFIYSFYVDKESVTVDGKASFCSVIPQTYSEMMTYVGGRRRAQDTANYVETLPFSGSGN

SEQ ID NO: 35 - DNA, 1530 bp, Candida viswanathii
  Candida ATACC strain 20336
atgatcagaaccgtccgttatcaatccttcaagaggttcaaacctctgactttatcccccgttttccgtccacgctacaactcccagaaggccaatttccaccgtccagaccacgctgggtccgacgagccagccgaagccgccgacgccgctgccacgatcctcgccgagttgcgagacaagcagacgaacccgaacaaggccacctggctcgatgcgttaacggagcgggagaagttgcgtgccgagggcaagacaatcgacagcttcagctacgttgaccccaagacaaccgtcgtgggggagaagacacgcagcgactcgttctcgttcttgttgttgccgttcaaggacgacaagtggttgtgtgacgcgtacatcaatgcgtttggccggttgcgtgtagcgcagttgttccaggacttggacgccttggcgggccgcatcgcgtacaggcactgttcccccgctgagcccgtgaatgtcacggcgagcgtggatagagtgtatatggtgaagaaagtggacgagattaataattacaatttcgtgttggcggggtccgtgacgtggaccgggagatcgtcgatggagatcacggtcaaagggtatgcttttgaagacgccgtgccggagataactaacgaggagtccttgccggcagagaatgtgttcttggctgttaatttcaccttcgtggcacgtaacccactcacacacaagtccttcgctattaacagattgttgcccgtgactgagaaggactgggtcgattatcgccgtgctgagtcccacaacgccaagaagaagttgatggcaaagaacaagaagatcttggagcctaccccggaagagtccaagttgatctacgacatgtggagatcgtccaagtccttacagaacatcgagaaggccaacgacgggatcgcgttcatgaaggacacgataatgaagtccaccttgttcatgcagccccagtaccgtaacagacactcatacatgattttcggtgggtatttgttaagacaaactttcgaattggcctattgtaccgcagcaacgttttccctggcgggaccccgtttcgtcagcttggactccaccacgttcaagaaccccgtgcccgtggggtcggtgctcaccatggactcgtcgatctcgtacacggagcacgtccacgatggcgttgaggagattgacgccgactccccgttcaacttcagcttgcctgccacgaacaagatctcgaagaaccccgaggcgttcttgtcggagcccggcacgttgatccaagtcaaggtcgacacgtacatccaggagttagagcaaagtgtgaagaagcctgcgggaacgttcatctactcgttctatgttgataaagagagcgttactgtggatggaaaggcgtcgttttgttcagttatcccgcagacgtactccgagatgatgacttatgtgggcgggagaagaagagcccaggatactgctaattacgtggagactttgccgtttagtggaagcggcaattaa

SEQ ID NO: 36 - protein, 509 aa, Candida viswanathii
  Candida ATACC strain 20336
MIRTVRYQSFKRFKPLTLSPVFRPRYNSQKANFHRPDHAGSDEPAEAADAAATILAELRDKQTNPNKATWLDALTEREKLRAEGKTIDSFSYVDPKTTVVGEKTRSDSFSFLLLPFKDDKWLCDAYINAFGRLRVAQLFQDLDALAGRIAYRHCSPAEPVNVTASVDRVYMVKKVDEINNYNFVLAGSVTWTGRSSMEITVKGYAFEDAVPEITNEESLPAENVFLAVNFTFVARNPLTHKSFAINRLLPVTEKDWVDYRRAESHNAKKKLMAKNKKILEPTPEESKLIYDMWRSSKSLQNIEKANDGIAFMKDTIMKSTLFMQPQYRNRHSYMIFGGYLLRQTFELAYCTAATFSLAGPRFVSLDSTTFKNPVPVGSVLTMDSSISYTEHVHDGVEEIDADSPFNFSLPATNKISKNPEAFLSEPGTLIQVKVDTYIQELEQSVKKPAGTFIYSFYVDKESVTVDGKASFCSVIPQTYSEMMTYVGGRRRAQDTANYVETLPFSGSGN

SEQ ID NO: 37 - DNA, 552 bp, Escherichia coli
atggccgatacattgctcatcttgggtgactctttgtctgcagggtatcggatgtccgcatctgccgcatggcctgcactcctcaatgacaaatggcaaagcaagacatcggtcgtgaatgcatctatctctggcgatacctcgcagcaggggttggcccgtctcccagccttgttgaagcaacatcaaccacgttgggtcttggtcgaattgggcggcaatgatggtctcagaggttttcaacctcaacagaccgagcagacattgcgtcaaatcctccaagacgtgaaggcagcaaacgccgaacctctcttgatgcagataagattgcctgccaactatggtcgtagatacaatgaagccttttctgcaatctacccgaagcttgcaaaggagtttgacgtcccattgttgccgtttttgatggaagaggtgtaccttaagcctcagtggatgcaagacgatggtatccatccgaaccgtgatgcacaaccattcatcgcagattggatggccaaacaactccaacctttggtcaatcatgatagctaa

SEQ ID NO: 38 - protein, 183 aa, Escherichia coli
MADTLLILGDSLSAGYRMSASAAWPALLNDKWQSKTSVVNASISGDTSQQGLARLPALLKQHQPRWVLVELGGNDGLRGFQPQQTEQTLRQILQDVKAANAEPLLMQIRLPANYGRRYNEAFSAIYPKLAKEFDVPLLPFLMEEVYLKPQWMQDDGIHPNRDAQPFIADWMAKQLQPLVNHDS

SEQ ID NO: 39 - DNA, 2091 bp, Candida viswanathii
  Candida ATACC strain 20336
atgggtgcccctttaacagtcgccgttggcgaagcaaaaccaggcgaaaccgctccaagaagaaaagccgctcaaaaaatggcctctgtcgaacgcccaacagactcaaaggcaaccactttgccagacttcattgaagagtgttttgccagaaacggcaccagagatgccatggcctggagagacttggtcgaaatccacgtcgaaaccaaacaggttaccaaaatcattgacggcgaacagaaaaaggtcgataaggactggatctactacgaaatgggtccttacaactacatatcctaccccaagttgttgacgttggtcaagaactactccaagggtttgttggagttgggcttggccccagatcaagaatccaagttgatgatctttgccagtacctcccacaagtggatgcagaccttcttagcctccagtttccaaggtatccccgttgtcaccgcctacgacaccttgggtgagtcgggcttgacccactccttggtgcaaaccgaatccgatgccgtgttcaccgacaaccaattgttgtcctccttgattcgtcctttggagaaggccacctccgtcaagtatgtcatccacggggaaaagattgaccctaacgacaagagacagggcggcaaaatctaccaggatgcggaaaaggccaaggagaagattttacaaattagaccagatattaaatttatttctttcgacgaggttgttgcattgggtgaacaatcgtccaaagaattgcatttcccaaaaccagaagacccaatctgtatcatgtacacctcgggttccaccggtgctccaaagggtgtggttatcaccaatgccaacattgttgccgccgtgggtggtatctccaccaatgctactagagacttggttagaactgtcgacagagtgattgcatttttgccattggcccacattttcgagttggcctttgagttggttaccttctggtggggggctccattgggttacgccaatgtcaagactttgaccgaagcctcctgcagaaactgtcagccagacttgattgaattcaaaccaaccatcatggttggtgttgctgccgtttgggaatcggtcagaaagggtgtcttgtctaaattgaaacaggcttctccaatccaacaaaagatcttctgggctgcattcaatgccaagtctactttgaaccgttatggcttgccaggcggtgggttgtttgacgctgtcttcaagaaggttaaagccgccactggtggccaattgcgttatgtgttgaatggtgggtccccaatctctgttgatgcccaagtgtttatctccaccttgcttgcgccaatgttgttgggttacggtttgactgaaacctgtgccaataccaccattgtcgaacacacgcgcttccagattggtactttgggtaccttggttggatctgtcactgccaagttggttgatgttgctgatgctggatactacgccaagaacaaccagggtgaaatctggttgaaaggcggtccagttgtcaaggaatactacaagaacgaagaagaaaccaaggctgcattcaccgaagatggctggttcaagactggtgatattggtgaatggaccgccgacggtggtttgaacatcattgaccgtaagaagaacttggtcaagactttgaatggtgaatacattgctttggagaaattggaaagtatttacagatccaaccacttgattttgaacttgtgtgtttacgctgaccaaaccaaggtcaagccaattgctattgtcttgccaattgaagccaacttgaagtctatgttgaaggacgaaaagattatcccagatgctgattcacaagaattgagcagcttggttcacaacaagaaggttgcccaagctgtcttgagacacttgctccaaaccggtaaacaacaaggtttgaaaggtattgaattgttgcagaatgttgtcttgttggatgacgagtggaccccacagaatggttttgttacttctgcccaaaagttgcagagaaagaagattttagaaagttgtaaaaaagaagttgaagaggcatacaagtcgtcttag

SEQ ID NO: 40 - protein, 696 aa, Candida viswanathii
  Candida ATACC strain 20336
MGAPLTVAVGEAKPGETAPRRKAAQKMASVERPTDSKATTLPDFIEECFARNGTRDAMAWRDLVEIHVETKQVTKIIDGEQKKVDKDWIYYEMGPYNYISYPKLLTLVKNYSKGLLELGLAPDQESKLMIFASTSHKWMQTFLASSFQGIPVVTAYDTLGESGLTHSLVQTESDAVFTDNQLLSSLIRPLEKATSVKYVIHGEKIDPNDKRQGGKIYQDAEKAKEKILQIRPDIKFISFDEVVALGEQSSKELHFPKPEDPICIMYTSGSTGAPKGVVITNANIVAAVGGISTNATRDLVRTVDRVIAFLPLAHIFELAFELVTFWWGAPLGYANVKTLTEASCRNCQPDLIEFKPTIMVGVAAVWESVRKGVLSKLKQASPIQQKIFWAAFNAKSTLNRYGLPGGGLFDAVFKKVKAATGGQLRYVLNGGSPISVDAQVFISTLLAPMLLGYGLTETCANTTIVEHTRFQIGTLGTLVGSVTAKLVDVADAGYYAKNNQGEIWLKGGPVVKEYYKNEEETKAAFTEDGWFKTGDIGEWTADGGLNIIDRKKNLVKTLNGEYIALEKLESIYRSNHLILNLCVYADQTKVKPIAIVLPIEANLKSMLKDEKIIPDADSQELSSLVHNKKVAQAVLRHLLQTGKQQGLKGIELLQNVVLLDDEWTPQNGFVTSAQKLQRKKILESCKKEVEEAYKSS

SEQ ID NO: 41 - DNA, 1950 bp, Candida viswanathii
  Candida ATACC strain 20336
atgtcaggattagaaatagccgctgctgccatccttggtagtcagttattggaagccaaatatttaattgccgacgacgtgctgttagccaagacagtcgctgtcaatgccctcccatacttgtggaaagccagcagaggtaaggcatcatactggtactttttcgagcagtccgtgttcaagaacccaaacaacaaagcgttggcgttcccaagaccaagaaagaatgcccccacccccaagaccgacgccgagggattccagatctacgacgatcagtttgacctagaagaatacacctacaaggaattgtacgacatggttttgaagtactcatacatcttgaagaacgagtacggcgtcactgccaacgacaccatcggtgtttcttgtatgaacaagccgcttttcattgtcttgtggttggcattgtggaacattggtgccttgcctgcgttcttgaacttcaacaccaaggacaagccattgatccactgtcttaagattgtcaacgcttcgcaagttttcgttgacccggactgtgattccccaatcagagataccgaggctcagatcagagaggaattgccacatgtgcaaataaactacattgacgagtttgccttgtttgacagattgagactcaagtcgactccaaaacacagagccgaggacaagaccagaagaccaaccgatactgactcctccgcttgtgcattgatttacacctcgggtaccaccggtttgccaaaagccggtatcatgtcctggagaaaagccttcatggcctcggttttctttggccacatcatgaagattgactcgaaatcgaacgtcttgaccgccatgcccttgtaccactccaccgcggccatgttggggttgtgtcctactttgattgtcggtggctgtgtctccgtgtcccagaaattctccgctacttcgttctggacccaggccagattatgtggtgccacccacgtgcaatacgtcggtgaggtctgtcgttacttgttgaactccaagcctcatccagaccaagacagacacaatgtcagaattgcctacggtaacgggttgcgtccagatatatggtctgagttcaagcgcagattccacattgaaggtatcggtgagttctacgccgccaccgagtcccctatcgccaccaccaacttgcagtacggtgagtacggtgtcggcgcctgtcgtaagtacgggtccctcatcagcttgttattgtctacccagcagaaattggccaagatggacccagaagacgagagtgaaatctacaaggaccccaagaccgggttctgtaccgaggccgcttacaacgagccaggtgagttgttgatgagaatcttgaaccctaacgacgtgcagaaatccttccagggttattatggtaacaagtccgccaccaacagcaaaatcctcaccaatgttttcaaaaaaggtgacgcgtggtacagatccggtgacttgttgaagatggacgaggacaaattgttgtactttgtcgacagattaggtgacactttccgttggaagtccgaaaacgtctccgccaccgaggtcgagaacgaattgatgggctccaaggccttgaagcagtccgtcgttgtcggtgtcaaggtgccaaaccacgaaggtagagcctgttttgccgtctgtgaagccaaggacgagttgagccatgaagaaatcttgaaattgattcactctcacgtgaccaagtctttgcctgtgtatgctcaacctgcgttcatcaagattggcaccattgaggcttcgcacaaccacaaggttcctaagaaccaattcaagaaccaaaagttgccaaagggtgaagacggcaaggatttgatctactggttgaatggcgacaagtaccaggagttgactgaagacgattggtctttgatttgtaccggtaaagccaaattg

SEQ ID NO: 42 - protein, 650 aa, Candida viswanathii
  Candida ATACC strain 20336
MSGLEIAAAAILGSQLLEAKYLIADDVSLAKTVAVNALPYLWKASRGKASYWYFFEQSVFKNPNNKALAFPRPRKNAPTPKTDAEGFQIYDDQFDLEEYTYKELYDMVLKYSYILKNEYGVTANDTIGVSCMNKPLFIVLWLALWNIGALPAFLNFNTKDKPLIHCLKIVNASQVFVDPDCDSPIRDTEAQIREELPHVQINYIDEFALFDRLRLKSTPKHRAEDKTRRPTDTDSSACALIYTSGTTGLPKAGIMSWRKAFMASVFFGHIMKIDSKSNVLTAMPLYHSTAAMLGLCPTLIVGGCVSVSQKFSATSFWTQARLCGATHVQYVGEVCRYLLNSKPHPDQDRHNVRIAYGNGLRPDIWSEFKRRFHIEGIGEFYAATESPIATTNLQYGEYGVGACRKYGSLISLLLSTQQKLAKMDPEDESEIYKDPKTGFCTEAAYNEPGELLMRILNPNDVQKSFQGYYGNKSATNSKILTNVFKKGDAWYRSGDLLKMDEDKLLYFVDRLGDTFRWKSENVSATEVENELMGSKALKQSVVVGVKVPNHEGRACFAVCEAKDELSHEEILKLIHSHVTKSLPVYAQPAFIKIGTIEASHNHKVPKNQFKNQKLPKGEDGKDLIYWLNGDKYQELTEDDWSLICTGKAKL

SEQ ID NO: 43 - DNA, 1764 bp, Candida viswanathii
  Candida ATACC strain 20336
atgtccgacgacgagatagcaggaatagtcattgaaatcgacgatgacgtgaaatccacgtcttcgttccaggaagaactagtcgaggttgaaatgtccaactcgtccattaacgaatcccagaccgatgagtcgtaccgtcctgaagaaacctcattgcattacaggaggaagtcccacaggaccccgtcagaggagtcgttcctagagatcaccaagaacgtgaatgatccggatctagtttccaagattgagaacctaaggggcaaagtaagccaacgggaagacaggttgaggaagcactaccttcacacctcccaggacgtcaagttcttgtcccggttcaacgacatcaagttcaagctgaactccgcgacgattctagattcggatgcgttttacaagagtgaatactttggagtcttgaccatcttctgggtggttatcgcactctacatattgtcaacgttgtcagatgtttactttggcatggccaagcccttactggactggatcatcataggaatgttcaagcaggacttggtgaaagttgcactcgttgatcttgccatgtacctatcctcgtattttccttatttcttgcaggttgcatgcaaacggggtgatgtatcttggcatggtcttggatgggcaatacagggggtttacagcttggtgtttttgacgttctggacggtagttccgcaggagttggccatggatcttccttggattgcacgaattttcttgatcttgcattgcttggtgtttattatgaagatgcagtcgtatgggcattacaatggatacctttgggatgtgtatcaggaaggattggcctctgaggctgatctcagggacctttctgagtatgatgaagatttccccctggatcacgtggaggttctagaacagagcttgtggtttgccaaacacgagttggagtttcaatcgaatggaactgctgagaggaaggaccaccatcaccatgtattcgacgaaaaggatgtcaacaaaccaatacgtgtcttgcaagaagagggaattatcaagtttccggcaaacatcaacttcaaggattatttcgagtacagtatgttcccaacgctagtctacacgttgagcttcccccgaactcgacagattagatggacgtatgtgttgcagaaggttttgggaacatttgccttagtgtttgccatgattatcgtcgccgaagagagtttctgccccttgatgcaagaagttgatcagtacacaaaattgccaaccaaccaaaggttcccaaaatacttcgtcgttctttcccacttgatattaccgctcggcaagcagtacttgctctcattcatcctcatctggaatgaaattctcaacggcatagcggagttaagcaggtttggcgaccggcatttctacggcgcttggtggtcgagcgtcgattacatggactattcaagaaaatggaacaccatcgtgcaccgattcctccgtcggcacgtttacaattcgagcattcacatcctcggtatttccaggacgcaagccgcgatagttacacttttgctttctgccacaatccacgaactcgttatgtacgtcctatttggcaaattacgagggtacctattccttacgatgcttgtccagatccccatgaccgtcacctccaagttcaacaaccgtgtttggggcaacatcatgttctggttgacgtatttatctggccccagcttggttagtgcgttgtatttactcttctag

SEQ ID NO: 44 - protein, 587 aa, Candida viswanathii
  Candida ATACC strain 20336
MSDDEIAGIVIEIDDDVKSTSSFQEELVEVEMSNSSINESQTDESYRPEETSLHYRRKSHRTPSEESFLEITKNVNDPDLVSKIENLRGKVSQREDRLRKHYLHTSQDVKFLSRFNDIKFKLNSATILDSDAFYKSEYFGVLTIFWVVIALYILSTLSDVYFGMAKPLLDWIIIGMFKQDLVKVALVDLAMYLSSYFPYFLQVACKRGDVSWHGLGWAIQGVYSLVFLTFWTVVPQELAMDLPWIARIFLILHCLVFIMKMQSYGHYNGYLWDVYQEGLASEADLRDLSEYDEDFPLDHVEVLEQSLWFAKHELEFQSNGTAERKDHHHHVFDEKDVNKPIRVLQEEGIIKFPANINFKDYFEYSMFPTLVYTLSFPRTRQIRWTYVLQKVLGTFALVFAMIIVAEESFCPLMQEVDQYTKLPTNQRFPKYFVVLSHLILPLGKQYLLSFILIWNEILNGIAELSRFGDRHFYGAWWSSVDYMDYSRKWNTIVHRFLRRHVYNSSIHILGISRTQAAIVTLLLSATIHELVMYVLFGKLRGYLFLTMLVQIPMTVTSKFNNRVWGNIMFWLTYLSGPSLVSALYLLF

SEQ ID NO: 45 - DNA, 1767 bp, Candida viswanathii
  Candida ATACC strain 20336
atgtccgacgacgagatagcaggaatagtcattgaaatcgacgatgacgtgaaatctacgtcttcgttccaggaagacctagtcgaggttgagatgtccaactcgtccattaacgaatcccagacggatgagttgtcgtaccgtcctgaagaaatctcattgcattcgagaaggaagtcccacaagaccccgtcagatgagtcgttcctagagatcaccaagaacgtgaatgatccggatctagtctccaagattgagaacttaaggggcaaagtaagccaacgggaagacaggttgaggaaacactacctccacacatcccaggacgtcaagttcttgtctcggttcaacgacatcaagttcaagctgaactccgcgacgattctagattcggatgcgttttacaagagcgagcactttggagtcttgactatcttctgggtggttatcggactctacataatgtcaacgttgtcagacatgtattttggcatggccaagcccttactggactggataatcataggaatgttcaagaaggatttgatgcaagttgcactcgttgatcttgtcatgtacttatcctcgtattttccttatttcctacaggttgcatgcaagaccggagctatatcttggcatggtcttggatgggccatacagggggtttacagcttggtgtttttaactttctgggcggtacttccgctggagctggccatggatcttccttggattgcacgagttttcttgatcttgcattgcttggtgtttattatgaagatgcaatcatatggacattacaatggatacctttgggatgtatatcaggaaggattggtctcggaagctgatctcacggctgtttctgagtatgatgatgatttccccctggatcacggggaggttctagaacagagcttgtggttcgccaaacacgagttggagtttcaatctaatggaactacggagaggaaggatcaccatcatcatgtattcgacgaaaaggatgtcaacaaaccaatgcgtgtcttgcaagaagagggaattatcaaatttccggcaaacatcaatttcaaggattatttcgagtacagtatgttccccacgctagtctacacattgaacttccccagaattcgacatattagatgggcgtatgtgttgcagaaagttttgggaacatttgccttagtgtttgccatgattatcgtcgccgaagagagtttctgtcccttgatgcaagaagttgaacagtacacaagattgccaaccaaccaaaggttctcaaagtacttcgtcgttctttcccacttgatattgcccctcggcaaacagtacttgctctcgtttatcctcatttggaacgaaattctcaacgggatagcggagttaagcaggtttggggatcgccatttctacggcgcctggtggtcaagcgtcgactacatggactattcaagaaaatggaacacgatcgtgcaccgattcctccgccggcacgtttacaattcgaccattcgcatcctcggtatttccaggacccaagccgcgataattacacttttgctttcagccacaatccacgaactcgttatgtacatcctatttggaaaattacgagggtacctattccttacgatgcttgtccagatccccatgacagtcaccgccaagttcaacaaccgtttgtggggcaacatcatgttctggttgacgtatttatctggccccagcttggttagtgcgttgtatttactcttctga

SEQ ID NO: 46 - protein, 588 aa, Candida viswanathii
  Candida ATACC strain 20336
MSDDEIAGIVIEIDDDVKSTSSFQEDLVEVEMSNSSINESQTDELSYRPEEISLHSRRKSHKTPSDESFLEITKNVNDPDLVSKIENLRGKVSQREDRLRKHYLHTSQDVKFLSRFNDIKFKSNSATILDSDAFYKSEHFGVLTIFWVVIGLYIMSTLSDMYFGMAKPLSDWIIIGMFKKDLMQVALVDLVMYLSSYFPYFLQVACKTGAISWHGLGWAIQGVYSLVFLTFWAVLPSESAMDLPWIARVFLILHCLVFIMKMQSYGHYNGYLWDVYQEGLVSEADLTAVSEYDDDFPSDHGEVLEQSLWFAKHELEFQSNGTTERKDHHHHVFDEKDVNKPMRVLQEEGIIKFPANINFKDYFEYSMFPTLVYTLNFPRIRHIRWAYVLQKVLGTFALVFAMIIVAEESFCPLMQEVEQYTRLPTNQRFSKYFVVLSHLILPLGKQYLLSFILIWNEILNGIAELSRFGDRHFYGAWWSSVDYMDYSRKWNTIVHRFLRRHVYNSTIRILGISRTQAAIITLLLSATIHELVMYILFGKLRGYLFLTMLVQIPMTVTAKFNNRLWGNIMFWLTYLSGPSLVSALYLLF

SEQ ID NO: 47 - DNA, 1716 bp, Candida viswanathii
  Candida ATACC strain 20336
atgactcaggactataaagacgatagtcctacgtccactgagttggacactaacatagaagaggtggaaagcactgcaaccctagagtcggaactcagacagagaaaacagaccacggaaactccagcatcaaccccaccaccacctccacaacaacagcaggcgcataagaaagccctgaagaatggcaagaggaagagaccatttataaacgtggcgccgctcaacaccccgttggctcacaggctcgagactttggctgttgtttggcactgtgtcagtatcccgttctttatgtttttgttcttgcttacggtctccatggggttgcttgggtggttctttatcattttgccatatttcatttggtggtacggtttcgacttgcacactccatcgaatggtaaagttgtctatcgtgtgcgcaactcgttcaagaatttcatcatttgggactggtttgtcaagtatttcccgattgaagtgcacaagacggtcgagttggatcctacttttagcgaattgcctgtggaagagagcggcgacagttcggacgacgacgaacaagacttggtgtctgagcacagcagaactttggttgatcaaatcttcaagtttttcgggttgaagaaacgcttgaatgacacctccctgggcaaaccagagacattcaagaatgtgcctacgggtccaaggtatatttttgggtaccacccacacggagtgatttctatgggggcagtggggttgtttgccaacaacgccttgaggaacgaaccatatacgccaatttccaaatggttaaaaccattcttccacgacagctccaagggcgagagattgttccctggtattggcaatatcttcccattgacgcttaccacacagtttgcgctcccattttaccgtgactacttgatggctttggggatcactagtgcatcggctaaaaacattagaagcttgatcaacaatggagacaactctgtgtgtctcgtcgttggcggtgcacaagaatcgttgttgaacaatatgattgccaagcacgccagagtcgggtacggttacaaagagagcctagatattcatggcgaccagtccgaagaagaagaagaagaagaggatgataccaagcagctagagaacccaagtcctaaacgtgaagtgcaattggtcttgaacaaacgtaaaggttttgtgaagttggctatcgaactaggaaatgtttccttggtgcctatttttgcattcggagaagctgatgtttacagattggcccagccagcaccaggctcgttcttgtacaagttccagcaatggatgaaggcaacttttcaattcaccatcccattgtttagtgctcgaggcgtgttcatctatgatttcggattgttgccattcagaaacccaataaacatttgcgtcggtagacccgtctacattccgcacaacgtcttgcaagaatacaagcaaaagcacccagaggagtttgccgaagaggaacctgccagtaccccgatgaagaagtctggatctttcaccgatatgttcaaagctggtgaaaagaagcccaagacttcaagtatcaagactaaaatcccacctgcattactagacaagtaccacaagctatacgtcgacgagttgaagaaggtctatgaagagaacaaggaaaggtttggctacggtgatgttgaattaaacattgtagaatag

SEQ ID NO: 48 - protein, 571 aa, Candida viswanathii
  Candida ATACC strain 20336
MTQDYKDDSPTSTELDTNIEEVESTATLESELRQRKQTTETPASTPPPPPQQQQAHKKASKNGKRKRPFINVAPLNTPLAHRLETLAVVWHCVSIPFFMFLFLLTVSMGLLGWFFIILPYFIWWYGFDLHTPSNGKVVYRVRNSFKNFIIWDWFVKYFPIEVHKTVELDPTFSELPVEESGDSSDDDEQDLVSEHSRTLVDQIFKFFGLKKRLNDTSSGKPETFKNVPTGPRYIFGYHPHGVISMGAVGLFANNALRNEPYTPISKWLKPFFHDSSKGERLFPGIGNIFPLTLTTQFALPFYRDYLMALGITSASAKNIRSLINNGDNSVCLVVGGAQESLLNNMIAKHARVGYGYKESLDIHGDQSEEEEEEEDDTKQLENPSPKREVQLVLNKRKGFVKLAIELGNVSLVPIFAFGEADVYRLAQPAPGSFLYKFQQWMKATFQFTIPLFSARGVFIYDFGLLPFRNPINICVGRPVYIPHNVLQEYKQKHPEEFAEEEPASTPMKKSGSFTDMFKAGEKKPKTSSIKTKIPPALLDKYHKLYVDELKKVYEENKERFGYGDVELNIVE

SEQ ID NO: 49 - DNA, 2079 bp, Candida viswanathii
  Candida ATACC strain 20336
atgtcgtctttaaagaacagaaaatccgcaagcgtcgccacaagcgatacagaagactcagaaacagaggcagtatcctcctcaattgatcccaacggcaccatattgcgaccagtcctacatgacgaaccccaccacagccatcaccaccacaacataactagaccagtattggaggacgatggcagcatcctggtgtccagaagatcgtcgatctccaaatccgacgacctgcaggcaaagcaaaagaagaagaaacccaagaagaagatcttggagtctcgtcgggtcatgtttatctttggtaccctcattgggttaatctttgcgtgggcgtttaccacagacacgcatcctttcaatggcgacttggagaagtttatcaactttgaccagctcaacgggatctttgacgactggaagaactggaaggatatcttgcccaacagcatccagacgtacttgcaggaatcgggcaagggcgaagataacgacgggttgcatggtctggccgattccttctccgtcgggctccgcttgaaagcccagaagaacttcactgacaaccacaatgtcgtgttggttcctggtgtggtgagcacggggttggaatcgtggggaacaaccaccaccggtgattgtccatctatcggatacttcaggaagagattgtggggatcattttatatgttaaggacaatgattttggagaaaacgtgctggttgaagcatatccagttggacgagaagacggggttggatcctcccaatattaaggtccgtgcggcgcagggtttcgaagcggcagatttctttatggctgggtactggatctggaacaagatcttgcagaacttggcggttattgggtacggaccaaataacatggtgagtgctagttatgactggagattggcttacattgacttggagagaagagatggatatttttcgaaacttaaagcgcagattgagttgaataacaagttgaacaacaagaagactgtgttgattggccactcgatggggacccagattattttctactttttgaaatgggtcgaagccaccgggaaaccatactatggcaatggcggaccaaactgggtgaatgatcatattgagtcgattattgacatcagtgggtcgactttgggtacccccaagagtattcctgtgttgatctctggggaaatgaaagacaccgttcaattgaacgcgttggcggtttacgggttggagcaatttttcagcaggcgtgaaagagtcgatatgttgcgtacatttggtggcgttgccagtatgttacccaaggggggagacaagatatggggcaacttgacgcatgcgccagatgatccaatttccacattcagtgatgacgaagttacggacagccacgaacctaaagatcgttcttttggtacgtttatccaattcaagaaccaaactagcgacgctaagccatacagggagatcaccatggctgaaggtatcgatgaattgttggacaaatcaccagactggtattccaagagagtccgtgagaactactcttacggcattacagacagcaaggcgcaattagagaagaacaacaatgaccacctgaagtggtcgaacccattagaagctgccttgcctaaagcacccgacatgaagatctattgtttctacggagttggaaatcctaccgaaagggcatacaagtatgtgactgccgataaaaaagccacgaaattggactacataatagacgccgacgatgccaatggagtcatattaggagacggagacggcactgtttcgttattaacccactcgatgtgccatgagtgggccaagggagacaagtcgagatacaacccagccaactcgaaggttaccattgttgaaatcaagcacgagccagacagatttgatttacgaggcggcgccaagactgcggaacatgttgatattttggggagtgccgagttgaacgagttgattttgactgtggttagcgggaacggggacgagattgagaatagatatgtcagcaacttaaaagaaatagtagaggccataaatttataa

SEQ ID NO: 50 - protein, 692 aa, Candida viswanathii
  Candida ATACC strain 20336
MSSLKNRKSASVATSDTEDSETEAVSSSIDPNGTILRPVLHDEPHHSHHHHNITRPVLEDDGSISVSRRSSISKSDDSQAKQKKKKPKKKILESRRVMFIFGTLIGLIFAWAFTTDTHPFNGDLEKFINFDQLNGIFDDWKNWKDILPNSIQTYLQESGKGEDNDGLHGSADSFSVGLRLKAQKNFTDNHNVVLVPGVVSTGLESWGTTTTGDCPSIGYFRKRLWGSFYMLRTMILEKTCWLKHIQLDEKTGLDPPNIKVRAAQGFEAADFFMAGYWIWNKILQNLAVIGYGPNNMVSASYDWRLAYIDLERRDGYFSKLKAQIELNNKLNNKKTVLIGHSMGTQIIFYFLKWVEATGKPYYGNGGPNWVNDHIESIIDISGSTLGTPKSIPVLISGEMKDTVQLNALAVYGLEQFFSRRERVDMLRTFGGVASMLPKGGDKIWGNLTHAPDDPISTFSDDEVTDSHEPKDRSFGTFIQFKNQTSDAKPYREITMAEGIDELLDKSPDWYSKRVRENYSYGITDSKAQLEKNNNDHSKWSNPLEAALPKAPDMKIYCFYGVGNPTERAYKYVTADKKATKLDYIIDADDANGVILGDGDGTVSLLTHSMCHEWAKGDKSRYNPANSKVTIVEIKHEPDRFDLRGGAKTAEHVDILGSAELNELILTVVSGNGDEIENRYVSNLKEIVEAINL

SEQ ID NO: 51 - DNA, 1260 bp, Cuphea lanceolata
atggtggctgctgcagcaacttctgcattcttccccgttccagccccgggaacctcccctaaacccgggaagtccggcaactggccatcgagcttgagccctaccttcaagcccaagtcaatccccaatgctggatttcaggttaaggcaaatgccagtgcccatcctaaggctaacggttctgcagtaaatctaaagtctggcagcctcaacactcaggaggacacttcgtcgtcccctcctccccgggctttccttaaccagttgcctgattggagtatgcttctgactgcaatcacgaccgtcttcgtggcggcagagaagcagtggactatgcttgataggaaatctaagaggcctgacatgctcgtggactcggttgggttgaagagtattgttcgggatgggctcgtgtccagacagagttttttgattagatcttatgaaataggcgctgatcgaacagcctctatagagacgctgatgaaccacttgcaggaaacatctatcaatcattgtaagagtttgggtcttctcaatgacggctttggtcgtactcctgggatgtgtaaaaacgacctcatttgggtgcttacaaaaatgcagatcatggtgaatcgctacccaacttggggcgatactgttgagatcaatacctggttctctcagtcggggaaaatcggtatggctagcgattggctaataagtgattgcaacacaggagaaattcttataagagcaacgagcgtgtgggctatgatgaatcaaaagacgagaagattctcaagacttccatacgaggttcgccaggagttaacacctcattttgtggactctcctcatgtcattgaagacaatgatcagaaattgcataagtttgatgtgaagactggtgattccattcgcaagggtctaactccgaggtggaatgacttggatgtgaatcagcacgtaagcaacgtgaagtacattgggtggattctcgagagtatgccaatagaagttttggagacccaggagctatgctctctcaccgttgaatataggcgggaatgcggaatggacagtgtgctggagtccgtgactgctgtggatccctcagaaaatggaggccggtctcagtacaagcaccttttgcggcttgaggatgggactgatatcgtgaagagcagaactgagtggcgaccgaagaatgcaggaactaacggggcgatatcaacatcaacagcaaagacttcaaatggaaactcggcctcttag

SEQ ID NO: 52 - protein, 523 aa, Candida sp.
MATQEIIDSVLPYLTKWYTVITAAVLVFLISTNIKNYVKAKKLKCVDPPYLKDAGLTGISSLIAAIKAKNDGRLANFADEVFDEYPNHTFYLSVAGALKIVMTVDPENIKAVLATQFTDFSLGTRHAHFAPLLGDGIFTLDGEGWKHSRAMLRPQFARDQIGHVKALEPHIQIMAKQIKLNQGKTFDIQELFFRFTVDTATEFLFGESVHSLYDEKLGIPTPNEIPGRENFAAAFNVSQHYLATRSYSQTFYFLTNPKEFRDCNAKVHHLAKYFVNKALNFTPEELEEKSKSGYVFLYELVKQTRDPKVLQDQLLNIMVAGRDTTAGLLSFALFELARHPEMWSKLREEIEVNFGVGEDSRVEEITFEALKRCEYLKAILNETLRMYPSVPVNFRTATRDTTLPRGGGANGTDPIYIPKGSTVAYVVYKTHRLEEYYGKDANDFRPERWFEPSTKKLGWAYVPFNGGPRVCLGQQFALTEASYVITRLAQMFETVSSDPGLEYPPPKCIHLTMSHNDGVFVKM

SEQ ID NO: 53 - protein, 522 aa, Candida sp.
MTVHDIIATYFTKWYVIVPLALIAYRVLDYFYGRYLMYKLGAKPFFQKQTDGCFGFKAPLELLKKKSDGTLIDFTLQRIHDLDRPDIPTFTFPVFSINLVNTLEPENIKAILATQFNDFSLGTRHSHFAPLLGDGIFTLDGAGWKHSRSMLRPQFAREQISHVKLLEPHVQVFFKHVRKAQGKTFDIQELFFRLTVDSATEFLFGESVESLRDESIGMSINALDFDGKAGFADAFNYSQNYLASRAVMQQLYWVLNGKKFKECNAKVHKFADYYVNKALDLTPEQLEKQDGYVFLYELVKQTRDKQVLRDQLLNIMVAGRDTTAGLLSFVFFELARNPEVTNKLREEIEDKFGLGENASVEDISFESLKSCEYLKAVLNETLRLYPSVPQNFRVATKNTTLPRGGGKDGLSPVLVRKGQTVIYGVYAAHRNPAVYGKDALEFRPERWFEPETKKLGWAFLPFNGGPRICLGQQFALTEASYVTVRLLQEFAHLSMDPDTEYPPKKMSHLTMSLFDGANIEMY

SEQ ID NO: 54 - protein, 522 aa, Candida sp.
MTAQDIIATYITKWYVIVPLALIAYRVLDYFYGRYLMYKLGAKPFFQKQTDGYFGFKAPLELLKKKSDGTLIDFTLERIQALNRPDIPTFTFPIFSINLISTLEPENIKAILATQFNDFSLGTRHSHFAPLLGDGIFTLDGAGWKHSRSMLRPQFAREQISHVKLLEPHMQVFFKHVRKAQGKTFDIQELFFRLTVDSATEFLFGESVESLRDESIGMSINALDFDGKAGFADAFNYSQNYLASRAVMQQLYWVLNGKKFKECNAKVHKFADYYVSKALDLTPEQLEKQDGYVFLYELVKQTRDRQVLRDQLLNIMVAGRDTTAGLLSFVFFELARNPEVTNKLREEIEDKFGLGENARVEDISFESLKSCEYLKAVLNETLRLYPSVPQNFRVATKNTTLPRGGGKDGLSPVLVRKGQTVMYGVYAAHRNPAVYGKDALEFRPERWFEPETKKLGWAFLPFNGGPRICLGQQFALTEASYVTVRLLQEFGHLSMDPNTEYPPRKMSHLTMSLFDGANIEMY

SEQ ID NO: 55 - protein, 540 aa, Candida sp.
MSSSPSFAQEVLATTSPYIEYFLDNYTRWYYFIPLVLLSLNFISLLHTRYLERRFHAKPLGNFVRDPTFGIATPLLLIYLKSKGTVMKFAWGLWNNKYIVRDPKYKTTGLRIVGLPLIETMDPENIKAVLATQFNDFSLGTRHDFLYSLLGDGIFTLDGAGWKHSRTMLRPQFAREQVSHVKLLEPHVQVFFKHVRKHRGQTFDIQELFFRLTVDSATEFLFGESAESLRDESIGLTPTTKDFDGRRDFADAFNYSQTYQAYRFLLQQMYWILNGSEFRKSIAVVHKFADHYVQKALELTDDDLQKQDGYVFLYELAKQTRDPKVLRDQLLNILVAGRDTTAGLLSFVFYELSRNPEVFAKLREEVENRFGLGEEARVEEISFESLKSCEYLKAVINETLRLYPSVPHNFRVATRNTTLPRGGGEDGYSPIVVKKGQVVMYTVIATHRDPSIYGADADVFRPERWFEPETRKLGWAYVPFNGGPRICLGQQFALTEASYVTVRLLQEFAHLSMDPDTEYPPKLQNTLTLSLFDGADVRMY

SEQ ID NO: 56 - protein, 540 aa, Candida sp.
MSSSPSFAQEVLATTSPYIEYFLDNYTRWYYFIPLVLLSLNFISLLHTKYLERRFHAKPLGNVVLDPTFGIATPLILIYLKSKGTVMKFAWSFWNNKYIVKDPKYKTTGLRIVGLPLIETIDPENIKAVLATQFNDFSLGTRHDFLYSLLGDGIFTLDGAGWKHSRTMLRPQFAREQVSHVKLLEPHVQVFFKHVRKHRGQTFDIQELFFRLTVDSATEFLFGESAESLRDDSVGLTPTTKDFEGRGDFADAFNYSQTYQAYRFLLQQMYWILNGAEFRKSIAIVHKFADHYVQKALELTDDDLQKQDGYVFLYELAKQTRDPKVLRDQLLNILVAGRDTTAGLLSFVFYELSRNPEVFAKLREEVENRFGLGEEARVEEISFESLKSCEYLKAVINEALRLYPSVPHNFRVATRNTTLPRGGGKDGCSPIVVKKGQVVMYTVIGTHRDPSIYGADADVFRPERWFEPETRKLGWAYVPFNGGPRICLGQQFALTEASYVTVRLLQEFGNLSSDPNAEYPPKLQNTLTLSLFDGADVRMF

SEQ ID NO: 57 - protein, 517 aa, Candida sp.
MIEQLLEYWYVVVPVLYIIKQLLAYTKTRVLMKKLGAAPVTNKLYDNAFGIVNGWKALQFKKEGRAQEYNDYKFDHSKNPSVGTYVSILFGTRIVVTKDPENIKAILATQFGDFSLGKRHTLFKPLLGDGIFTLDGEGWKHSRAMLRPQFAREQVAHVTSLEPHFQLLKKHILKHKGEYFDIQELFFRFTVDSATEFLFGESVHSLKDESIGINQDDIDFAGRKDFAESFNKAQEYLAIRTLVQTFYWLVNNKEFRDCTKSVHKFTNYYVQKALDASPEELEKQSGYVFLYELVKQTRDPNVLRDQSLNILLAGRDTTAGLLSFAVFELARHPEIWAKLREEIEQQFGLGEDSRVEEITFESLKRCEYLKAFLNETLRIYPSVPRNFRIATKNTTLPRGGGSDGTSPILIQKGEAVSYGINSTHLDPVYYGPDAAEFRPERWFEPSTKKLGWAYLPFNGGPRICLGQQFALTEAGYVLVRLVQEFSHVRSDPDEVYPPKRLTNLTMCLQDGAIVKFD

SEQ ID NO: 58 - protein, 517 aa, Candida sp.
MIEQILEYWYIVVPVLYIIKQLIAYSKTRVLMKQLGAAPITNQLYDNVFGIVNGWKALQFKKEGRAQEYNDHKFDSSKNPSVGTYVSILFGTKIVVTKDPENIKAILATQFGDFSLGKRHALFKPLLGDGIFTLDGEGWKHSRSMLRPQFAREQVAHVTSLEPHFQLLKKHILKHKGEYFDIQELFFRFTVDSATEFLFGESVHSLKDETIGINQDDIDFAGRKDFAESFNKAQEYLSIRILVQTFYWLINNKEFRDCTKSVHKFTNYYVQKALDATPEELEKQGGYVFLYELVKQTRDPKVLRDQSLNILLAGRDTTAGLLSFAVFELARNPHIWAKLREEIEQQFGLGEDSRVEEITFESLKRCEYLKAFLNETLRVYPSVPRNFRIATKNTTLPRGGGPDGTQPILIQKGEGVSYGINSTHLDPVYYGPDAAEFRPERWFEPSTRKLGWAYLPFNGGPRICLGQQFALTEAGYVLVRLVQEFSHIRSDPDEVYPPKRLTNLTMCLQDGAIVKFD

SEQ ID NO: 59 - protein, 512 aa, Candida sp.
MLDQILHYWYIVLPLLAIINQIVAHVRTNYLMKKLGAKPFTHVQRDGWLGFKFGREFLKAKSAGRSVDLIISRFHDNEDTFSSYAFGNHVVFTRDPENIKALLATQFGDFSLGSRVKFFKPLLGYGIFTLDAEGWKHSRAMLRPQFAREQVAHVTSLEPHFQLLKKHILKHKGEYFDIQELFFRFTVDSATEFLFGESVHSLKDEEIGYDTKDMSEERRRFADAFNKSQVYVATRVALQNLYWLVNNKEFKECNDIVHKFTNYYVQKALDATPEELEKQGGYVFLYELVKQTRDPKVLRDQSLNILLAGRDTTAGLLSFAVFELARNPHIWAKLREEIEQQFGLGEDSRVEEITFESLKRCEYLKAVLNETLRLHPSVPRNARFAIKDTTLPRGGGPNGKDPILIRKDEVVQYSISATQTNPAYYGADAADFRPERWFEPSTRNLGWAFLPFNGGPRICLGQQFALTEAGYVLVRLVQEFPNLSQDPETKYPPPRLAHLTMCLFDGAHVKMS

SEQ ID NO: 60 - protein, 512 aa, Candida sp.
MLDQIFHYWYIVLPLLVIIKQIVAHARTNYLMKKLGAKPFTHVQLDGWFGFKFGREFLKAKSAGRQVDLIISRFHDNEDTFSSYAFGNHVVFTRDPENIKALLATQFGDFSLGSRVKFFKPLLGYGIFTLDGEGWKHSRAMLRPQFAREQVAHVTSLEPHFQLLKKHILKHKGEYFDIQELFFRFTVDSATEFLFGESVHSLRDEEIGYDTKDMAEERRKFADAFNKSQVYLSTRVALQTLYWLVNNKEFKECNDIVHKFTNYYVQKALDATPEELEKQGGYVFLYELAKQTKDPNVLRDQSLNILLAGRDTTAGLLSFAVFELARNPHIWAKLREEIESHFGSGEDSRVEEITFESLKRCEYLKAVLNETLRLHPSVPRNARFAIKDTTLPRGGGPNGKDPILIRKNEVVQYSISATQTNPAYYGADAADFRPERWFEPSTRNLGWAYLPFNGGPRICLGQQFALTEAGYVLVRLVQEFPSLSQDPETEYPPPRLAHLTMCLFDGAYVKMQ

SEQ ID NO: 61 - protein, 499 aa, Candida sp.
MAISSLLSWDVICVVFICVCVYFGYEYCYTKYLMHKHGAREIENVINDGFFGFRLPLLLMRASNEGRLIEFSVKRFESAPHPQNKTLVNRALSVPVILTKDPVNIKAMLSTQFDDFSLGLRLHQFAPLLGKGIFTLDGPEWKQSRSMLRPQFAKDRVSHISDLEPHFVLLRKHIDGHNGDYFDIQELYFRFSMDVATGFLFGESVGSLKDEDARFSEAFNESQKYLATRATLHELYFLCDGFRFRQYNKVVRKFCSQCVHKALDVAPEDTSEYVFLRELVKHTRDPVVLQDQALNVLLAGRDTTASLLSFATFELARNDHMWRKLREEVISTMGPSSDEITVAGLKSCRYLKAILNETLRLYPSVPRNARFATRNTTLPRGGGPDGSFPILIRKGQPVGYFICATHLNEKVYGNDSHVFRPERWAALEGKSLGWSYLPFNGGPRSCLGQQFAILEASYVLARLTQCYTTIQLRTTEYPPKKLVHLTMSLLNGVYIRTRT

SEQ ID NO: 62 - protein, 418 aa, Candida sp.
MHALFSKSVFLKYVSSPTTSAIPHSSEFIVPRSFYLRRSISPYLPHSSLFPSFSYSSSSVYTKKSFHTMSANIPKTQKAVVFEKNGGELEYKDIPVPTPKANELLINVKYSGVCHTDLHAWKGDWPLATKLPLVGGHEGAGVVVGMGENVKGWKIGDFAGIKWLNGSCMSCEFCQQGAEPNCGEADLSGYTHDGSFEQYATADAVQAARIPAGTDLAEVAPILCAGVTVYKALKTADLAAGQWVAISGAGGGLGSLAVQYAVAMGLRVVAIDGGDEKGAFVKSLGAEAYIDFLKEKDIVSAVKKATDGGPHGAINVSVSEKAIDQSVEYVRPLGKVVLVGLPAGSKVTAGVFEAVVKSIEIKGSYVGNRKDTAEAVDFFSRGLIKCPIKIVGLSELPQVFKLMEEGKILGRYVLDTSK

SEQ ID NO: 63 - protein, 680 aa, Candida sp.
MALDKLDLYVIITLVVAIAAYFAKNQFLDQQQDTGFLNTDSGDGNSRDILQALKKNNKNTLLLFGSQTGTAEDYANKLSRELHSRFGLKTMVADFADYDFENFGDITEDILVFFIVATYGEGEPTDNADEFHTWLTEEADTLSTLKYTVFGLGNSTYEFFNAIGRKFDRLLGEKGGDRFAEYGEGDDGTGTLDEDFLAWKDNVFDSLKNDLNFEEKELKYEPNVKLTERDDLSGNDPDVSLGEPNVKYIKSEGVDLTKGPFDHTHPFLARIVKTKELFTSEDRHCVHVEFDISESNLKYTTGDHLAIWPSNSDENIKQFAKCFGLEDKLDTVIELKALDSTYSIPFPNPITYGAVIRHHLEISGPVSRQFFLSIAGFAPDEETKKSFTRIGGDKQEFASKVTRRKFNIADALLFASNNRPWSDVPFEFLIENVQHLTPRYYSISSSSLSEKQTINVTAVVEAEEEADGRPVTGVVTNLLKNIEIEQNKTGETPMVHYDLNGPRGKFSKFRLPVHVRRSNFKLPKNSTTPVILIGPGTGVAPLRGFVRERVQQVKNGVNVGKTVLFYGCRNSEQDFLYKQEWSEYASVLGENFEMFNAFSRQDPTKKVYVQDKILENSALVDELLSSGAIIYVCGDASRMARDVQAAIAKIVAKSRDIHEDKAAELVKSWKVQNRYQEDVW

SEQ ID NO: 64 - protein, 679 aa, Candida sp.
MALDKLDLYVIITLVVAVAAYFAKNQFLDQPQDTGFLNTDSGSNSRDVLSTLKKNNKNTLLLFGSQTGTAEDYANKLSRELHSRFGLKTMVADFADYDWDNFGDITEDILVFFIVATYGEGEPTDNADEFHTWLTEEADTLSTLKYTVFGLGNSTYEFFNAIGRKFDRLLSEKGGDRFAEYAEGDDGTGTLDEDFMAWKDNVFDALKNDLNFEEKELKYEPNVKLTERDDLSAADSQVSLGEPNKKYINSEGIDLTKGPFDHTHPYLARITETRELFSSKDRHCIHVEFDISESNLKYTTGDHLAIWPSNSDENIKQFAKCFGLEDKLDTVIELKALDSTYTIPFPTPITYGAVIRHHLEISGPVSRQFFLSIAGFAPDEETKKAFTRLGGDKQEFAAKVTRRKFNIADALLYSSNNAPWSDVPFEFLIENVPHLTPRYYSISSSSLSEKQLINVTAVVEAEEEADGRPVTGVVTNLLKNVEIVQNKTGEKPLVHYDLSGPRGKFNKFKLPVHVRRSNFKLPKNSTTPVILIGPGTGVAPLRGFVRERVQQVKNGVNVGKTLLFYGCRNSNEDFLYKQEWAEYASVLGENFEMFNAFSRQDPSKKVYVQDKILENSQLVHELLTEGAIIYVCGDASRMARDVQTTISKIVAKSREISEDKAAELVKSWKVQNRYQEDVW

SEQ ID NO: 65 - protein, 679 aa, Candida sp.
MALDKLDLYVIITLVVAVAAYFAKNQFLDQPQDTGFLNTDSGSNSRDVLSTLKKNNKNTLLLFGSQTGTAEDYANKLSRELHSRFGLKTMVADFADYDWDNFGDITEDILVFFIVATYGEGEPTDNADEFHTWLTEEADTLSTLRYTVFGLGNSTYEFFNAIGRKFDRLLSEKGGDRFAEYAEGDDGTGTLDEDFMAWKDNVFDALKNDLNFEEKELKYEPNVKLTERDDLSAADSQVSLGEPNKKYINSEGIDLTKGPFDHTHPYLARITETRELFSSKERHCIHVEFDISESNLKYTTGDHLAIWPSNSDENIKQFAKCFGLEDKLDTVIELKALDSTYTIPFPTPITYGAVIRHHLEISGPVSRQFFLSIAGFAPDEETKKTFTRLGGDKQEFATKVTRRKFNIADALLYSSNNTPWSDVPFEFLIENIQHLTPRYYSISSSSLSEKQLINVTAVVEAEEEADGRPVTGVVTNLLKNIEIAQNKTGEKPLVHYDLSGPRGKFNKFKLPVHVRRSNFKLPKNSTTPVILIGPGTGVAPLRGFVRERVQQVKNGVNVGKTLLFYGCRNSNEDFLYKQEWAEYASVLGENFEMFNAFSRQDPSKKVYVQDKILENSQLVHELLTEGAIIYVCGDASRMARDVQTTISKIVAKSREISEDKAAELVKSWKVQNRYQEDVW

SEQ ID NO: 66 - DNA, 3147 bp, Bacillus megaterium
atgacaattaaagaaatgcctcagccaaaaacgtttggagagcttaaaaatttaccgttattaaacacagataaaccggttcaagctttgatgaaaattgcggatgaattaggagaaatctttaaattcgaggcgcctggtcgtgtaacgcgctacttatcaagtcagcgtctaattaaagaagcatgcgatgaatcacgctttgataaaaacttaagtcaagcgcttaaatttgtacgtgattttgcaggagacgggttatttacaagctggacgcatgaaaaaaattggaaaaaagcgcataatatcttacttccaagcttcagtcagcaggcaatgaaaggctatcatgcgatgatggtcgatatcgccgtgcagcttgttcaaaagtgggagcgtctaaatgcagatgagcatattgaagtaccggaagacatgacacgtttaacgcttgatacaattggtctttgcggctttaactatcgctttaacagcttttaccgagatcagcctcatccatttattacaagtatggtccgtgcactggatgaagcaatgaacaagctgcagcgagcaaatccagacgacccagcttatgatgaaaacaagcgccagtttcaagaagatatcaaggtgatgaacgacctagtagataaaattattgcagatcgcaaagcaagcggtgaacaaagcgatgatttattaacgcatatgctaaacggaaaagatccagaaacgggtgagccgcttgatgacgagaacattcgctatcaaattattacattcttaattgcgggacacgaaacaacaagtggtcttttatcatttgcgctgtatttcttagtgaaaaatccacatgtattacaaaaagcagcagaagaagcagcacgagttctagtagatcctgttccaagctacaaacaagtcaaacagcttaaatatgtcggcatggtcttaaacgaagcgctgcgcttatggccaactgctcctgcgttttccctatatgcaaaagaagatacggtgcttggaggagaatatcctttagaaaaaggcgacgaactaatggttctgattcctcagcttcaccgtgataaaacaatttggggagacgatgtggaagagttccgtccagagcgttttgaaaatccaagtgcgattccgcagcatgcgtttaaaccgtttggaaacggtcagcgtgcgtgtatcggtcagcagttcgctcttcatgaagcaacgctggtacttggtatgatgctaaaacactttgactttgaagatcatacaaactacgagctggatattaaagaaactttaacgttaaaacctgaaggctttgtggtaaaagcaaaatcgaaaaaaattccgcttggcggtattccttcacctagcactgaacagtctgctaaaaaagtacgcaaaaaggcagaaaacgctcataatacgccgctgcttgtgctatacggttcaaatatgggaacagctgaaggaacggcgcgtgatttagcagatattgcaatgagcaaaggatttgcaccgcaggtcgcaacgcttgattcacacgccggaaatcttccgcgcgaaggagctgtattaattgtaacggcgtcttataacggtcatccgcctgataacgcaaagcaatttgtcgactggttagaccaagcgtctgctgatgaagtaaaaggcgttcgctactccgtatttggatgcggcgataaaaactgggctactacgtatcaaaaagtgcctgcttttatcgatgaaacgcttgccgctaaaggggcagaaaacatcgctgaccgcggtgaagcagatgcaagcgacgactttgaaggcacatatgaagaatggcgtgaacatatgtggagtgacgtagcagcctactttaacctcgacattgaaaacagtgaagataataaatctactctttcacttcaatttgtcgacagcgccgcggatatgccgcttgcgaaaatgcacggtgcgttttcaacgaacgtcgtagcaagcaaagaacttcaacagccaggcagtgcacgaagcacgcgacatcttgaaattgaacttccaaaagaagcttcttatcaagaaggagatcatttaggtgttattcctcgcaactatgaaggaatagtaaaccgtgtaacagcaaggttcggcctagatgcatcacagcaaatccgtctggaagcagaagaagaaaaattagctcatttgccactcgctaaaacagtatccgtagaagagcttctgcaatacgtggagcttcaagatcctgttacgcgcacgcagcttcgcgcaatggctgctaaaacggtctgcccgccgcataaagtagagcttgaagccttgcttgaaaagcaagcctacaaagaacaagtgctggcaaaacgtttaacaatgcttgaactgcttgaaaaatacccggcgtgtgaaatgaaattcagcgaatttatcgcccttctgccaagcatacgcccgcgctattactcgatttcttcatcacctcgtgtcgatgaaaaacaagcaagcatcacggtcagcgttgtctcaggagaagcgtggagcggatatggagaatataaaggaattgcgtcgaactatcttgccgagctgcaagaaggagatacgattacgtgctttatttccacaccgcagtcagaatttacgctgccaaaagaccctgaaacgccgcttatcatggtcggaccgggaacaggcgtcgcgccgtttagaggctttgtgcaggcgcgcaaacagctaaaagaacaaggacagtcacttggagaagcacatttatacttcggctgccgttcacctcatgaagactatctgtatcaagaagagcttgaaaacgcccaaagcgaaggcatcattacgcttcataccgctttttctcgcatgccaaatcagccgaaaacatacgttcagcacgtaatggaacaagacggcaagaaattgattgaacttcttgatcaaggagcgcacttctatatttgcggagacggaagccaaatggcacctgccgttgaagcaacgcttatgaaaagctatgctgacgttcaccaagtgagtgaagcagacgctcgcttatggctgcagcagctagaagaaaaaggccgatacgcaaaagacgtgtgggctggg

SEQ ID NO: 67 - protein, 411 aa, Candida sp.
MGEIQKITVKNPIVEMDGDEMTRIIWQFIKDKLILPYLNVDLKYYDLGIEYRDQTDDKVTTDAAEAILKYGVGVKCATITPDEARVKEFNLKKMWLSPNGTLRNVLGGTVFREPIVIDNIPRIVPSWEKPIIIGRHAFGDQYKATDVVIPAAGDLKLVFKPKDGGEVQEYPVYQFDGRGVALSMYNTDASITDFAESSFQLAIERKLNLFSSTKNTILKKYDGKFKDIFEGLYASKYKTKMDELGIWYEHRLIDDMVAQMLKSKGGYIIAMKNYDGDVQSDIVAQGFGSLGLMTSVLVTPDGKAFESEAAHGTVTRHYRQHQQGKETSTNSIASIYAWTRGLVQRGKLDDTPEVVKFAEELEKAVIETVSKDNIMTKDLALTQGKTDRSSYVTTEEFIDGVANRLNKNLGY

SEQ ID NO: 68 - DNA, 1233 bp, Candida sp.
atgggcgaaattcagaaaataacagtcaagaacccaatcgtcgaaatggacggtgacgaaatgacccgtatcatctggcaattcatcaaagacaagttgatcttgccttatttgaacgttgacttgaaatactacgacttgggcatcgagtacagagaccagaccgacgacaaggtcaccaccgatgctgctgaagccatcttgaaatacggtgtcggtgtcaagtgtgccaccatcaccccagacgaagccagagttaaagaattcaacttgaagaagatgtggctctctccaaacggtactttgagaaacgtccttggtggtactgtcttcagagaaccaattgtcattgacaacatcccaagaatcgtgcctagctgggaaaaaccaatcatcattggtagacacgctttcggcgaccaatacaaggccaccgacgtggttatcccagctgccggtgacttgaagttggtgttcaagccaaaagacggcggtgaagtgcaagaatacccagtctaccagttcgacggtcgaggtgtcgccttgagcatgtacaacaccgacgcttcaatcactgatttcgctgaaagttccttccaattggccattgagcgtaaattgaacttgttttcttccaccaaaaacaccatcttgaagaaatacgacgggaaattcaaagacatattcgaaggcttgtacgccagcaaatacaagaccaagatggacgaattgggcatctggtacgagcacagattgattgacgatatggttgcacagatgttgaagtctaaaggtggttacatcatcgccatgaaaaactacgatggtgatgtccaatccgacattgtcgcacaaggtttcggttccttgggtttgatgacctctgttttggttaccccagacggcaaggcttttgaatccgaggctgcccacggtactgtcactagacattatagacaacaccaacaaggtaaagagacctcgaccaactccattgcctccatctacgcctggaccagagggttggtccaaagaggtaagttggatgacactccggaagttgtcaagtttgctgaagagttggaaaaggctgtcattgagactgtctccaaggacaacatcatgaccaaagatttggccttgacccaaggtaagaccgacagatcttcgtatgtcacgactgaagaattcatcgatggtgttgctaatagattgaacaaaaacttgggctac

SEQ ID NO: 69 - protein, 420 aa, Saccharomyces cerevisiae
MSKIKVVHPIVEMDGDEQTRVIWKLIKEKLILPYLDVDLKYYDLSIQERDRTNDQVTKDSSYATLKYGVAVKCATITPDEARMKEFNLKEMWKSPNGTIRNILGGTVFREPIIIPKIPRLVPHWEKPIIIGRHAFGDQYRATDIKIKKAGKLRLQFSSDDGKENIDLKVYEFPKSGGIAMAMFNTNDSIKGFAKASFELALKRKLPLFFTTKNTILKNYDNQFKQIFDNLFDKEYKEKFQALKITYEHRLIDDMVAQMLKSKGGFIIAMKNYDGDVQSDIVAQGFGSLGLMTSILITPDGKTFESEAAHGTVTRHFRKHQRGEETSTNSIASIFAWTRAIIQRGKLDNTDDVIKFGNLLEKATLDTVQVGGKMTKDLALMLGKTNRSSYVTTEEFIDEVAKRLQNMMLSSNEDKKGMCKL

SEQ ID NO: 70 - DNA, 1263 bp, Saccharomyces cerevisiae
atgagtaaaattaaagttgttcatcccatcgtggaaatggacggtgatgagcagacaagagttatttggaaacttatcaaagaaaaattgatattgccatatttagatgtggatttaaaatactatgacctttcaatccaagagcgtgataggactaatgatcaagtaacaaaggattcttcttatgctaccctaaaatatggggttgctgtcaaatgtgccactataacacccgatgaggcaagaatgaaagaatttaaccttaaagaaatgtggaaatctccaaatggaacaatcagaaacatcctaggtggaactgtatttagagaacccatcattattccaaaaatacctcgtctagtccctcactgggagaaacctataattataggccgtcatgcttttggtgaccaatatagggctactgacatcaagattaaaaaagcaggcaaactaaggttacagtttagctcagatgacggtaaagaaaacatcgatttaaaggtttatgaatttcctaaaagtggtgggatcgcaatggcaatgtttaatacaaatgattccattaaagggttcgcaaaggcatccttcgaattagctctcaaaagaaaactaccgttattctttacaaccaaaaacactattctgaaaaattatgataatcagttcaaacaaattttcgataatttgttcgataaagaatataaggaaaagtttcaggctttaaaaataacgtacgagcatcgtttgattgatgatatggtagcacagatgctaaaatcaaagggcgggtttataatcgccatgaagaattatgatggcgatgtccagtctgacattgtggcacaaggatttgggtctcttggtttaatgacgtccatattgattacacctgatggtaaaacgtttgaaagcgaggctgcccatggtacggtgaccagacattttagaaaacatcaaagaggcgaagaaacatcaacaaattcaatagcctcaatatttgcctggacaagggcaattatacaaagaggaaaattagacaatacagatgatgttataaaatttggaaacttactagaaaaggctactttggacacagttcaagtgggcggaaaaatgaccaaggatttagcattgatgcttggaaagactaatagatcatcatatgtaaccacagaagagtttattgatgaagttgccaagaggcttcaaaacatgatgctcagctccaatgaagacaagaaaggtatgtgcaaactataa

SEQ ID NO: 71 - DNA, 1071 bp, Kluyveromyces lactis
atgcccgatatgacaaacgaatcttcttctaagccagctcaaattaacattggtatcaatggttttggtagaatcggtagattggttctacgtgctgctttgacgcacccagaagttaaggtcagattaatcaataatccatccacaacaccagaatacgctgcttatttgttcaaatacgattctactcacggcaagtatcgtggtgaagttgaattcgacgatgaacgtatcatcattcaaaatgaccatgtttcggctcatatccctctatctcattttagggaaccagagcgtatcccatgggcttcctacaacgtcgattatgtaattgactcaaccggtgtcttcaaggaagtcgatacagcctctagacataaaggtgtcaaaaaagttatcattactgctccatcaaagaccgcgccaatgtacgtctatggtgttaaccacgttaaatacaacccattgacggatcacgtggtctctaatgcctcctgtactaccaactgtttggctccgttggttaaggctttggacgatgagttcggtatcgaagaagccttgatgacaactattcatgcaactactgcttctcaaaagactgtcgatggtaccagttctggtggtaaggactggagaggcggtagatcttgccagggaaatatcattccttcatctactggtgcagctaaggctgtagggaaaatcttgcctgaacttaatggtaagatcaccggtatgtctataagagtcccaacaattaatatttccctggttgacttgacattccgtacagcaaagaaaacttcttacgatgacattatgaaggccctagaacaaagatctcgcagcgatatgaagggtgttttgggtgttaccaaagacgccgttgtgtcctctgacttcacatccgattcacgttcatctattgttgatgccaaggccggtattgaattgaacgaccattttttcaaggtcctttcttggtatgataatgaatatggttactcttcaagagtggttgatttatccattttcatggctcaaaaggacttcgaagctggtgtttaa

SEQ ID NO: 72 - protein, 356 aa, Kluyveromyces lactis
MPDMTNESSSKPAQINIGINGFGRIGRLVLRAALTHPEVKVRLINNPSTTPEYAAYLFKYDSTHGKYRGEVEFDDERIIIQNDHVSAHIPLSHFREPERIPWASYNVDYVIDSTGVFKEVDTASRHKGVKKVIITAPSKTAPMYVYGVNHVKYNPLTDHVVSNASCTTNCLAPLVKALDDEFGIEEALMTTIHATTASQKTVDGTSSGGKDWRGGRSCQGNIIPSSTGAAKAVGKILPELNGKITGMSIRVPTINISLVDLTFRTAKKTSYDDIMKALEQRSRSDMKGVLGVTKDAVVSSDFTSDSRSSIVDAKAGIELNDHFFKVLSWYDNEYGYSSRVVDLSIFMAQKDFEAGV

SEQ ID NO: 73 - DNA, 1500 bp, Candida sp.
atgtcttatgattcattcggtgactacgtcactatcgtcgttttcggtgcttccggtgacttggccagcaaaaaaaccttccctgccttgtttggcttgtttagagaaaagcaattgcccccaaccgtccagatcattggctatgccagatcccatttgtccgacaaggacttcaaaaccaagatctcctcccacttcaagggcggcgacgaaaaaaccaagcaagacttcttgaacttgtgtacttatatcagcgacccatacgacactgacgatggttacaagagattggaagccgccgctcaagaatacgaatccaagcacaacgtcaaggtccctgaaagattgttttacttggccttgcctccttctgtcttccacaccgtctgtgagcaagtcaagaagatcgtctaccctaaggacggtaagctcagaatcatcattgaaaagccgttcggacgtgatttggccacctaccgtgaattgcaaaagcaaatctccccattgttcaccgaagacgaactctacagaattgaccactacttgggtaaagaaatggtcaagaacttgttggttttgagattcggtaacgaattgttcagtgggatctggaacaacaagcacatcacctcggtgcaaatctccttcaaggaacccttcggtaccgaaggtagaggtggctactttgacaacattggtatcatcagagatgtcatgcaaaaccacttgttgcaagtcttgaccttgttgaccatggaaagaccagtctcttttgacccagaagctgtcagagacgaaaaggtcaaggttttgaaagcttttgacaagattgacgtcaacgacgttcttttgggacaatacgccaagtctgaggatggctccaagccaggttacttggatgactccaccgtcaagccaaactccaaggctgtcacctacgccgctttcagagtcaacatccacaacgaaagatgggacggtgttccaattgttttgagagccggtaaggctttagacgaaggtaaagttgaaattagaatccaattcaagccagttgccaaaggtatgtttaaggagatccaaagaaacgaattggttattagaatccaaccagacgaagccatctacttgaagatcaactccaagatcccaggtatctccaccgaaacttccttgaccgacttggacttgacttactccaagcgttactccaaggacttctggatcccagaagcatacgaagccttgatcagagactgttacttgggcaaccactccaactttgtcagagacgatgaattggaagttgcttggaagctcttcaccccattgttggaagccgttgaaaaagaagacgaagtcagcttgggaacctacccatacggatccaagggtcctaaagaattgagaaagtacttggtcgaccacggttacgtcttcaacgacccaggtacttaccaatggccattgaccaacaccgatgtcaaaggtaagatctaa

SEQ ID NO: 74 - protein, 499 aa, Candida sp.
MSYDSFGDYVTIVVFGASGDLASKKTFPALFGLFREKQLPPTVQIIGYARSHLSDKDFKTKISSHFKGGDEKTKQDFLNLCTYISDPYDTDDGYKRLEAAAQEYESKHNVKVPERLFYLALPPSVFHTVCEQVKKIVYPKDGKLRIIIEKPFGRDLATYRELQKQISPLFTEDELYRIDHYLGKEMVKNLLVLRFGNELFSGIWNNKHITSVQISFKEPFGTEGRGGYFDNIGIIRDVMQNHLLQVLTLLTMERPVSFDPEAVRDEKVKVLKAFDKIDVNDVLLGQYAKSEDGSKPGYLDDSTVKPNSKAVTYAAFRVNIHNERWDGVPIVLRAGKALDEGKVEIRIQFKPVAKGMFKEIQRNELVIRIQPDEAIYLKINSKIPGISTETSLTDLDLTYSKRYSKDFWIPEAYEALIRDCYLGNHSNFVRDDELEVAWKLFTPLLEAVEKEDEVSLGTYPYGSKGPKELRKYLVDHGYVFNDPGTYQWPLTNTDVKGKI

SEQ ID NO: 75 - DNA, 1500 bp, Candida sp.
atgtcttatgattcattcggtgactacgtcactatcgtcgttttcggtgcttccggtgacttggccagaaaaaaaaccttccctgccttgtttggcttgtttagagaaaagcaattgcccccaaccgtccagatcattggctatgccagatcccatttgtccgacaaggacttcaaaaccaagatctcctcccacttcaagggcggcgacgaaaaaaccaagcaagacttcttgaacttgtgctcttatatgagtgacccatacgacaccgacgacggttacaagaaattggaagccaccgctcaagaatacgaatccaagcacaacgtaaaggtcccagaaagattgttctacttggccttgcctccttccgtcttccacaccgtctgtgagcaagtcaagaagctcgtctaccctaaggacggtaagctcagaatcatcattgaaaagccgtttggccgtgacttggccacctaccgtgaattgcaaaagcaaatctccccattgttcaccgaagacgaagtctacagaatcgaccactacttgggtaaagaaatggtcaagaacttgttggttttgagattcggtaatgaattgttcagtgggatctggaacaacaagcacatcacctcggtgcaaatttccttcaaggaacccttcggtaccgaaggcagaggtggctactttgacaacattggtatcatcagagatgtcatgcaaaaccacttgttgcaagtcttgaccttgttgaccatggaaagaccagtctcttttgacccagaagcagtcagagacgaaaaggtcaaagttttgaaagcttttgacaacattgacgtcaatgacgttcttttgggacaatacgccaagtccgaggatggctccaagccaggttacttggatgactccaccgtcaagccaaactccaaggctgtcacctacgccgctttcagagtcaacatccacaacgaaagatgggacggtgttccaattgttttgagagccggtaaggctttagacgaaggtaaagttgaaattagaatccaattcaagccagtcgctaaaggtatgtttaaggaaatccaaagaaacgaattggttattagaatccaaccagacgaagccatctacttgaagatcaactccaagatcccaggtatctccaccgaaacctccttgaccgacttggacttgacttactccaagcgttactccaaagacttctggatcccagaagcatacgaagccttgatcagagactgttacttgggcaaccactccaactttgtcagagacgatgaattggaagttgcttggaagctcttcaccccattgttggaagccgttgaaaaagaagacgaagtcagcttgggaacctacccatacggatccaagggtcctaaagaattgagaaagtacttggtcgaccacggttacgtcttcaacgacccaggtacttaccaatggccattgaccaacaccgatgtcaaaggtaagatctaa

SEQ ID NO: 76 - protein, 499 aa, Candida sp.
MSYDSFGDYVTIVVFGASGDLARKKTFPALFGLFREKQLPPTVQIIGYARSHLSDKDFKTKISSHFKGGDEKTKQDFLNLCSYMSDPYDTDDGYKKLEATAQEYESKHNVKVPERLFYLALPPSVFHTVCEQVKKLVYPKDGKLRIIIEKPFGRDLATYRELQKQISPLFTEDEVYRIDHYLGKEMVKNLLVLRFGNELFSGIWNNKHITSVQISFKEPFGTEGRGGYFDNIGIIRDVMQNHLLQVLTLLTMERPVSFDPEAVRDEKVKVLKAFDNIDVNDVLLGQYAKSEDGSKPGYLDDSTVKPNSKAVTYAAFRVNIHNERWDGVPIVLRAGKALDEGKVEIRIQFKPVAKGMFKEIQRNELVIRIQPDEAIYLKINSKIPGISTETSLTDLDLTYSKRYSKDFWIPEAYEALIRDCYLGNHSNFVRDDELEVAWKLFTPLLEAVEKEDEVSLGTYPYGSKGPKELRKYLVDHGYVFNDPGTYQWPLTNTDVKGKI

SEQ ID NO: 77 - DNA, 1653 bp, Candida sp.
atgtccactttcaagttagccaccgaattgccagaatggaaaaaattggaacaaacctacaagtccgtgggtgaaaagttcagcgtcagagatgccttcgctaacgacaagaacagattcgaagagttctcctggatctaccaaaactacgacgactccaagatcttgtttgatttctccaagaacttggtcaacaaggagatcttggaccaattgatcaccttggccaaagaagctggtgtcgagaaattgagagacgctatgtttgctggtgatcacatcaacaccaccgaagacagagccgtgtaccacgttgccttgagaaaccgtgccttgagaaaaatgccagtcgacggtaaggacaccgccaaggaagttgacgacgtcttgcaacacatgaaggaattctccgactccatcagagacggctcttggaccggttacactggtaaggccatcaccgatgttgtcaacattggtattggtggttccgacttgggtccagtcatggttactgaagccttgaaggcctacagcaagccaggcttgaacgtccactttatctccaacattgacggtacccacacccacgaaaccttgaagaacttgaacccagaaaccaccttgttcttggttgcttccaagaccttcaccaccgctgaaaccatcaccaacgccacctccgccaaaaactggttcttagctgccgctaaggatccaaagcacattgccaagcatttcgctgctttgtccaccaacgaagctgaggttgaaaaattcggtatcgacgtcaagaacatgtttggtttcgaaagttgggtcggtggtcgttactctgtctggtccgccattggtttgtctgtcgccatctacattggtttcgaaaacttcaacgacttcttgaagggtggtgaagccatggaccaacactttttgaccactcctttggaaaacaacatcccagtcattggtggtttgttgtctgtctggtacaacaacttctttggtgctcaaacccacttggttgttccattcgaccaatacttgcacagattcccagcttacttgcaacaattgtctatggaatccaacggtaagtctgtcactagagccaacgtcttcaccaactaccaaaccggtaccatcttgtttggtgagccagccaccaacgcccaacactccttcttccaattggtgcaccaaggtaccaagttgatcccagctgacttcatcttggctgctcaatcccacaacccaattgaaaacaacttgcaccaaaagatgttggcctccaacttctttgctcaatccgaagctttgatggttggtaaggacgaagccaaggttaaagccgaaggtgccactggtggtttggttccacacaaggaattctctggtaacagaccaaccacctccatcttggctcaaaagatcaccccagccgctttgggttctttgattgcctactacgaacacgttactttcaccgaaggtgctatctggaacatcaactctttcgaccaatggggtgttgaattgggtaaggttttggctaaggtcattggtaaggaattggatgacaagtccgctgttgttacccacgatgcctccaccaacggtttgatcaaccaattcaagaaatgggaagcttga

SEQ ID NO: 78 - protein, 550 aa, Candida sp.
MSTFKLATELPEWKKLEQTYKSVGEKFSVRDAFANDKNRFEEFSWIYQNYDDSKILFDFSKNLVNKEILDQLITLAKEAGVEKLRDAMFAGDHINTTEDRAVYHVALRNRALRKMPVDGKDTAKEVDDVLQHMKEFSDSIRDGSWTGYTGKAITDVVNIGIGGSDLGPVMVTEALKAYSKPGLNVHFISNIDGTHTHETLKNLNPETTLFLVASKTFTTAETITNATSAKNWFLAAAKDPKHIAKHFAALSTNEAEVEKFGIDVKNMFGFESWVGGRYSVWSAIGLSVAIYIGFENFNDFLKGGEAMDQHFLTTPLENNIPVIGGLLSVWYNNFFGAQTHLVVPFDQYLHRFPAYLQQLSMESNGKSVTRANVFTNYQTGTILFGEPATNAQHSFFQLVHQGTKLIPADFILAAQSHNPIENNLHQKMLASNFFAQSEALMVGKDEAKVKAEGATGGLVPHKEFSGNRPTTSILAQKITPAALGSLIAYYEHVTFTEGAIWNINSFDQWGVELGKVLAKVIGKELDDKSAVVTHDASTNGLINQFKKWEA

SEQ ID NO: 79 - DNA, 2157 bp, Candida sp.
atgccagcattattcaaagattctgcccaacacatacttgacaccatcaagtctgaactcccacttgatcccctcaaaaccgcatatgctgtgccgcttgaaaattcagccgaaccaggctactctgccatctacagaaacaaatactccatcgataagttaattgataccccataccccggcttggacaccttgtacaagttgtttgaggttgccactgaagcatacggtgataaaccatgtcttggtgccagagtcaagaacgccgatggcacctttggagaatacaagttccaagactacaacaccattcaccaaagaagaaacaacttcgggtcaggtattttctttgtcttacagaacaacccatacaagaccgattctgaagcccactccaagttgaagtacgacccaacaagcaaggattccttcatcttgacaatcttcagtcacaaccgtcctgaatgggccttgtgtgatttgaccagtattgcctattccatcaccaacaccgctttgtacgacactttgggtcccgacaccagtaagtacattttgggtttgactgagtcgccaattgtcatctgttccaaggataagattagaggtcttattgacttgaagaagaacaacccagacgaattgtccaacttgattgttttagtgtccatggatgacttgaccaccgctgatgcctctttgaagaactacggtagtgaacacaacgtcactgtttttgacatcaagcaggttgagaaattgggtgagatcaacccattggacccaatcgagccaaccccagacaccaatttcaccattactttcacctctggtaccaccggtgctaacccaaagggtgtcttgttgaaccacagaaacgctgtcgctggtgtcacttttgtgctcagtagatacgatggccatttcaacccaacagcttattctttccttcccttggcccacatttacgaaagagctagcatccagtttgcattgactatcggttccgccattggattcccacaaggtccatctccattgactttgattgaagatgccaaggtgttgcaaccagacggtttggctttggttcctagagtcttgaccaagttggaagctgccatcagggcacaaactgtcaacaatgacgaaaaaccattggttaaatcggtctttggagctgctatcaacgccaagatggaagcacaaatgaaagaagaaaacgaaaacttcaacccaagtttcattgtctatgatcgtttgttgaacttgttgagaaagaaggttggtttgcaaaaagttacccaaatcagtaccggaagtgctccaatctctccatcaactattcaattcttgaaagcttccttgaatgtcggtatcttgcaaggttacggtttgagtgaatcatttgctggatgtatggcttcttccaaattcgaaccagcggcagccacttgtggtcctactggtgtcaccactgaagtcaagttgaaggatcttgaagaaatgggttacacttccaaggatgaaggtggtccaagaggtgagttattattgagaggtccacaaatcttcaagggatatttcaagaaccctgaggaaactgccaaggccattgacgaagatggttggttccatactggtgatgttgccaagatcaacgacaaaggcagaatttccatcattgatagagcaaagaatttcttcaaattggctcaaggtgaatacgttaccccagagaaaatcgaaggtttgtacttgtccaagttcccatacattgcccaattatttgtccatggtgactctaaggaatcgtacttggttggtgttgtcggattagacccagttgctggtaagcagtacatggagtcgagattccacgacaagatcatcaaggaagaggacgttgttgagttcttcaagtccccaagaaacagaaagatcttagtgcaagacatgaacaagctgattgctgaccaattgcaaggttttgagaagttgcacaacatctacgttgactttgacccattgacggtcgaaagaggcgtcattactccaaccatgaagatcagaagaccacttgctgccaagttcttccaggatcaaatcgatgctatgtacagcgaaggatcattggttagaaatggttctttgtag

SEQ ID NO: 80 - protein, 718 aa, Candida sp.
MPALFKDSAQHILDTIKSELPLDPLKTAYAVPLENSAEPGYSAIYRNKYSIDKLIDTPYPGLDTLYKLFEVATEAYGDKPCLGARVKNADGTFGEYKFQDYNTIHQRRNNFGSGIFFVLQNNPYKTDSEAHSKLKYDPTSKDSFILTIFSHNRPEWALCDLTSIAYSITNTALYDTLGPDTSKYILGLTESPIVICSKDKIRGLIDLKKNNPDELSNLIVLVSMDDLTTADASLKNYGSEHNVTVFDIKQVEKLGEINPLDPIEPTPDTNFTITFTSGTTGANPKGVLLNHRNAVAGVTFVLSRYDGHFNPTAYSFLPLAHIYERASIQFALTIGSAIGFPQGPSPLTLIEDAKVLQPDGLALVPRVLTKLEAAIRAQTVNNDEKPLVKSVFGAAINAKMEAQMKEENENFNPSFIVYDRLLNLLRKKVGLQKVTQISTGSAPISPSTIQFLKASLNVGILQGYGLSESFAGCMASSKFEPAAATCGPTGVTTEVKLKDLEEMGYTSKDEGGPRGELLLRGPQIFKGYFKNPEETAKAIDEDGWFHTGDVAKINDKGRISIIDRAKNFFKLAQGEYVTPEKIEGLYLSKFPYIAQLFVHGDSKESYLVGVVGLDPVAGKQYMESRFHDKIIKEEDVVEFFKSPRNRKILVQDMNKSIADQLQGFEKLHNIYVDFDPLTVERGVITPTMKIRRPLAAKFFQDQIDAMYSEGSLVRNGSL

SEQ ID NO: 81 - DNA, 2250 bp, Candida sp.
atgacatcgacacagagtatcttctccggcgagaagtacactaaggaagaagcgttagcacaattacctttcgggagtgctgttgagaatgctgtcgctataaacgagccagttacaaaccccaagtattctgcaatcttcagaaatgcagcccatctcgaccgcatggttcagaacgtgcaccctgatttaaacacccactacaagctcttcaacaatgctgctgagatgtaccgtgaccgtccatgtcttggtaagcgtccatacaactacaccacacaccaactggatgattacttcctgcactggacgtatggtgaggtctttacgaagaagaataacattggtgctgggtttattcgcgcgttattggagaaccctttccttgacgtgacgttggagtcgcataggaagattgtcaatcatttacgtgactggcccactttcggcatcaacaaatcaccaagggagaacttgaactatgagattgagaagaattgttcgttcattttgactatttttgccgtcaatcgtgctgaatggatcttgactgatttggcatgcagttcgtatgcaatcacaaacaccgcgttgtatgatacattaggtcccgacgtgtctcagtatatcttgaacttgactgaatcaccaattgtcgtttgcacccatgacaagatccaggttttgttgaacttgaaaagaaagtaccctgagcagaccaagaacttgatttctatcgtgtcaatggacccaattgatttagtcacgcagggaacaatcgaacaagcttatgagttgggggtcacaattcaaggtttgaatcagattgagaaaattggtgttctgaacccaattcaacaattggaaactggtacagaagctttgtttaccatttcattcacttcaggaactactggtagtaaacccaaaggagtgatgatttctcaaggtggtgctgctgcctacgtcacgtgggggttgagctgttgtccacaggctaaacctggtgataaggcgtatattttcttgccgttgactcatttgtatgaaagagaaacttgtgcgtttgcctatagttctgggtactatttggggttcccgcagattaacctaggcaaaaagaaggtgaatccttttgagaacatgcttaacgatttgagaatcttcaaaccaacatatatgtccatggttcctagattattgaccaggttggaagcgttgatcaagagtaagatcaaggagttgccacaagctgaccaggacagagtgaatggtataattgagatcaagataagggagcaaagcaaggctgacggcgccaaagggtttgacgcaaccttggacaacgaccctacctacaaatcattagctaagtttgttgggtatgaaaacatgagatgggttcagactgcaagtgcaccaattgcccccaccacacttgtctacttgaaagcgtctttgaacatcggtgccagacaacaatacgggttgactgaaagtggggccgccatcacaagtaccggggagtacgaagcatccccaggaggttgtggtgttgtattaccaactgggcagtgccgactctactccgtttccgagatggggtactccttggacaaattagaaggcgaggtgttgctccagggcccacagatgttcaaagggtactactacaactacgaggaaaccgagaatgcagttactgaagacggatggttccattcaggagacattgctcgggttgaccccgcgacaggtcgcctcgacataattgaccgagtcaagcatttcttcaaattggctcagggagagtacatctccccagagcgtatcgagaacaggtacttgtcgtcgaacccagacatctgccagctctgggtgcacggggactctaaggagcactacttgattggcatagtgggggtggagtacgaaaaaggattgaagtttatcaatgaggagtttggatataacaagattgacatgcagccggatgatttgttggacattttgaactcggcggaggtgaaggcacggttcttgagcaagctaaatagactggttaaagataagttgaacgggtttgagatcttgcataatatctttattgagtttgagccgttgacggtccagagagaagttgttactccgacattcaaaattagaagaccaatctgtcgtaagttcttcaaggcccagcttgatgcgatgtacgccgaggggtccttaatcagcgctgccaagttgtag

SEQ ID NO: 82 - protein, 749 aa, Candida sp.
MTSTQSIFSGEKYTKEEALAQLPFGSAVENAVAINEPVTNPKYSAIFRNAAHLDRMVQNVHPDLNTHYKLFNNAAEMYRDRPCLGKRPYNYTTHQSDDYFSHWTYGEVFTKKNNIGAGFIRALLENPFLDVTLESHRKIVNHLRDWPTFGINKSPRENLNYEIEKNCSFILTIFAVNRAEWILTDLACSSYAITNTALYDTLGPDVSQYILNLTESPIVVCTHDKIQVLLNLKRKYPEQTKNLISIVSMDPIDLVTQGTIEQAYELGVTIQGLNQIEKIGVSNPIQQLETGTEALFTISFTSGTTGSKPKGVMISQGGAAAYVTWGLSCCPQAKPGDKAYIFLPLTHLYERETCAFAYSSGYYLGFPQINLGKKKVNPFENMLNDLRIFKPTYMSMVPRLLTRLEALIKSKIKELPQADQDRVNGIIEIKIREQSKADGAKGFDATLDNDPTYKSLAKFVGYENMRWVQTASAPIAPTTLVYLKASLNIGARQQYGLTESGAAITSTGEYEASPGGCGVVLPTGQCRLYSVSEMGYSLDKLEGEVLLQGPQMFKGYYYNYEETENAVTEDGWFHSGDIARVDPATGRLDIIDRVKHFFKLAQGEYISPERIENRYLSSNPDICQLWVHGDSKEHYLIGIVGVEYEKGLKFINEEFGYNKIDMQPDDLLDILNSAEVKARFLSKLNRSVKDKLNGFEILHNIFIEFEPLTVQREVVTPTFKIRRPICRKFFKAQLDAMYAEGSLISAAKL

SEQ ID NO: 83 - DNA, 2157 bp, Candida sp.
atgtccaccttattcaacgagccacctgaacagatctaccagagtctcttgactcagtacaacaacccactcgattacgcatccagtgttgcactcccaaatacgcaagaaccgggatattcatctatctacaggaatgtgtttgatcccagtaagcttgttacctgtccacatcccgagttagacacgttgtacaaaatttttgagttcagtgttattgtttacggagacaagccgttccttggccaccggatcaaaaacccagatggtacctttggcgagtacacgtttgaaacttacaagcaggtctatgaaagaagaaacaatcttggttctggtatctactacgtcttggaaaacagtccataccggacctcatccgaagctcatgcgaaattaaagtatgaccctaccaacgacaacccattcattttggcgcttttcagtcataatcgtccagaatgggcattgtgtgatgtcacaaccagtgcttatggtttcatcaacactgcattgtacagcaccttgggtccagataccagcagatacatcttgtctgtcaccgattgtccaattgtagttgccacgaaggacaagattgaagggttgatcaacttgaagaagaaaaatcccaaagacttggtcaacttgattgttcttgtttcattagatgaacttaccgttgaagacgataagttgagatcattgggtcgtgaaaacaacattgtggtttatgctttgaaggaagttgaaagactcggtgcagctaacccattggcaccaattgctccaaccccagacactgtcttcacgatttcgtttacttcgggtaccagcggagcagcacctaaaggtgttgtgttgacaaatagaatcttggcttgcggaatagcatcccattgttctctcgttgggtttggtcctgaccgtgtcgagtacagtttcttgcctttggctcatatctacgagagaatggtgcttcagtttggaataatagctggagtgaagatcgggtatccacagggtccttctccaacaaccttgtttgaagacatcaaggttttgcaaccaacgatgttgtgtttggttcccagagtattcacgaagatagaagctgccatcaaggcccagacagttgaaaatgaatcagatccagaactcagagctaagtttatcgaaataatcaacaagaaagtggagttgcaacaacaacaggactttacaaatccaagtctcccagaaggtgacaagctcttacaacaattgcgtgagacccttggaatgggtaaacttcaattcatgaacactggatcagctccactgtcagaggagtcttatcgttttatccaagctgtgatgaacatgcctaatgggttccgttgtggttacggtttgacagaaagcgctgctggtcttgcaatctccccaccatacgccaatgaattctcatgtgggcccatttcccagaccaccgagtttagattgaaagatcttgttgatatgggttacacttcgaaagataaagagggagtaaggggtgaattgttattgagaggtcctcaaatcttctcttactactacaagaacccagaggagacggccaaggctatagacaaggacggatggttccatactggtgatgtggcttctctcaccgaagcacatggaaacaggtttcagattatcgacagagccaagaacttcttcaagttgtcccaaggagagtatgtgtctccagagaagattgaaaatgtgtacatggctcagtttccgttcatctcgcagttgtttgttcatggagattcattggagtcatatttggttggtgtcgttggaatcgacaaagcattggttgatccttatttgaagaaacgcttcaacgtggagttggacacaccagctgagatcttcaagttttttgagaacccacggaacagaaagacattgttgcaagacatgaacaaggcggttggtagtgagttgcaaggattcgaaaaattgcataatgtttttgttgattttgaaccattgacccttgagagaggagttattacgccaactgtcaagatcagaagagctaactgtgtcaacttctttaagcagcacatccaaagtatgtatggcgaaggatctttgctcaagaatagtaacttatag

SEQ ID NO: 84 - protein, 718 aa, Candida sp.
MSTLFNEPPEQIYQSLLTQYNNPLDYASSVALPNTQEPGYSSIYRNVFDPSKLVTCPHPELDTLYKIFEFSVIVYGDKPFLGHRIKNPDGTFGEYTFETYKQVYERRNNLGSGIYYVLENSPYRTSSEAHAKLKYDPTNDNPFILALFSHNRPEWALCDVTTSAYGFINTALYSTLGPDTSRYILSVTDCPIVVATKDKIEGLINLKKKNPKDLVNLIVLVSLDELTVEDDKLRSLGRENNIVVYALKEVERLGAANPLAPIAPTPDTVFTISFTSGTSGAAPKGVVLTNRILACGIASHCSLVGFGPDRVEYSFLPLAHIYERMVLQFGIIAGVKIGYPQGPSPTTLFEDIKVLQPTMLCLVPRVFTKIEAAIKAQTVENESDPELRAKFIEIINKKVELQQQQDFTNPSLPEGDKLLQQLRETLGMGKLQFMNTGSAPSSEESYRFIQAVMNMPNGFRCGYGLTESAAGLAISPPYANEFSCGPISQTTEFRLKDLVDMGYTSKDKEGVRGELLLRGPQIFSYYYKNPEETAKAIDKDGWFHTGDVASLTEAHGNRFQIIDRAKNFFKLSQGEYVSPEKIENVYMAQFPFISQLFVHGDSLESYLVGVVGIDKALVDPYLKKRFNVELDTPAEIFKFFENPRNRKTLLQDMNKAVGSELQGFEKLHNVFVDFEPLTLERGVITPTVKIRRANCVNFFKQHIQSMYGEGSLLKNSNL

SEQ ID NO: 85 - DNA, 1884 bp, Candida sp.
atgtttaactttaagttgtcgcaacaagtattaaagaattccaccaaatccattatgccaattttgaaaaaaccattctccaccagccacgcaaagggtgacttgttcaaataccagtcacaattacccaagttgcctgttcctactttggaagaaaccgcatccaagtacctcaagaccgttgagccattcttgaaccaagagcaattggaatccaccaaggccaaagtcgctgagtttgttagaccaggtggtgccggtgaagccttgcaagccagattgaacaactttgccgccgacaaggacaactggttggctgaattttgggacgactatgcatacatgtcttatagagatcctgttgttccatatgtttcttactttttcagtcacaaggatgtcaagaacatcattggccaagaccaattgttgaaggccactttgattgcttactacactattgagttccaagaaaaggttttggacgaaagtttggacccagaagtcatcaagggtaacccattctgtatgaacgccttcaagtacatgttcaacaactcgagagttccagctgaaggctccgacatcacccaacactacaacggtgaagaaaaccaatttttcgttgtcatctacaagaacaacttctacaaggttccaacccacaagaacggccaaagattgaccaagggtgaaatctacagctacttgcaagaaatcaagaacgatgccactccaaagggtctcggtttgggtgctttgacctcattgaacagagacgaatggttgagtgcctacaacaacttgttgaagtccccaatcaacgaagcttccttgggatccatctttgcttccagctttgtcattgccttggactccaacaacccagtcaccattgaagaaaaatccaagaactgctggcacggggacggtcaaaacagattctttgacaagcctttggaattcttcgtcagtgctaacggtaactctggtttccttggtgaacactccagaatggacgctaccccaaccgtgcaattgaacaacaccatctacaagcaaatcttggaaaccaatccaaacgacttgattgttgaaattggttcttctgctccaagattcggcaatgctgaaatcttgcctttcgacatcaacccaaccaccagagccaacatcaaagacgctattgccaagtttgacgccaccattgctgcccacgacgaagaaatcttccaacactacggttacggtaagggattgatcaagaagttcaaggtctccccagatgcctacgtgcaattgttgatgcaattggcatacttcaagtacaccggcaagatcagaccaacttatgaatccgccgccaccagaaagttcttgaagggtagaaccgaaaccggtagaactgtctccaacgaatccaagaagtttgttgagacctggtccgatccaaaggccagcagcgccgacaaggttgccactttccaagctgctgctaagcaacacgttgcctatttgtctgctgctgccgatggtaagggtgttgaccgtcacttgtttggtttgaagcaaatgattcaaccaggcgaaccaatccctgaaatcttcactgacccaatcttcagctattctcaaacctggtacatttcttcttcccaagttccatctgaattcttccaatcttggggttggtcgcaagtcattgatgacggtttcggtttggcttacttgatcaacaacgactggatccacgttcacatttcttgtaagagaggcaacggcttgcaatctgaccacttgaaatggtacttggttgaaagtgctaatgaaatgaaggatgttttgactaagggattattgactgatgctaagcctaagttgtaa

SEQ ID NO: 86 - protein, 627 aa, Candida sp.
MFNFKLSQQVLKNSTKSIMPILKKPFSTSHAKGDLFKYQSQLPKLPVPTLEETASKYLKTVEPFLNQEQLESTKAKVAEFVRPGGAGEALQARLNNFAADKDNWLAEFWDDYAYMSYRDPVVPYVSYFFSHKDVKNIIGQDQLLKATLIAYYTIEFQEKVLDESLDPEVIKGNPFCMNAFKYMFNNSRVPAEGSDITQHYNGEENQFFVVIYKNNFYKVPTHKNGQRLTKGEIYSYLQEIKNDATPKGLGLGALTSLNRDEWLSAYNNLLKSPINEASLGSIFASSFVIALDSNNPVTIEEKSKNCWHGDGQNRFFDKPLEFFVSANGNSGFLGEHSRMDATPTVQLNNTIYKQILETNPNDLIVEIGSSAPRFGNAEILPFDINPTTRANIKDAIAKFDATIAAHDEEIFQHYGYGKGLIKKFKVSPDAYVQLLMQLAYFKYTGKIRPTYESAATRKFLKGRTETGRTVSNESKKFVETWSDPKASSADKVATFQAAAKQHVAYLSAAADGKGVDRHLFGLKQMIQPGEPIPEIFTDPIFSYSQTWYISSSQVPSEFFQSWGWSQVIDDGFGLAYLINNDWIHVHISCKRGNGLQSDHLKWYLVESANEMKDVLTKGLLTDAKPKL

SEQ ID NO: 87 - protein, 649 aa, Artificial Sequence
  Description of Artificial Sequence: Synthetic polypeptide
  MOD_RES (627)..(630): Any amino acid
MPQEDYSDIVSEATEFVSSSLINLIQRHLEAVAEREEFSNYLNVVNNDMTPSIYGEIRGDILPRNPYLILEEDPYSKTINPPNQAQRAANLINSSLKFIITLRNETLKPDVTPKHGNPLTMKCYRNLFGTTRIPEFEEHNHDIKMRKYEHINDSRHILIIANNQFYTLEVITEYTEEEYQETKSKHKIWFNDHELSLILQQIIDESKKVDAVKSINNSIGSLTTQTLKHWKLARLELEQSNLENIKKIDDALFVVILDSNAPETDGEKTAVISHGTSVLSADNVQVGTCTSRWYDKLQLIVTQNSVAGVVWESMSMDSTAILRFISDIYTDSVLKLAKNINGSEYTLFDSNIVFASSSISKPEAVMIYFNKTKELQNIIHLSETRLADLINQHEYMTHRIKLDSYLTSKFNLSVDSIMQVCFQIAYYSLYGRVVNTLEPITTRKFKDARTELIPVQNEVLGNLVKLYITSASALEKFEAFKKCCELHTHQYHDAMIGKGFERHLMTIIQVIKKPKAVVRLNELNSHLPPIPDLTKEPVTIPLLLNPAIDKLLSPELLISNCGNPALRLFGIPPAIDQGFGIGYIIHRDKVLITVCSKHRQTERFLDTFHRVVRDLKVNLRQKSNFLXXXXSVTRNKENTSCRGCESSMS

SEQ ID NO: 88 - DNA, 1947 bp, Artificial Sequence
  Description of Artificial Sequence: Synthetic polynucleotide
  modified_base (1879)..(1888): a, c, t, g, unknown or other
atgccgcaggaggactactcagacatcgtgagcgaggccaccgagtttgtctctagcagcttgatcaacttgatccagcggcacttggaagctgttgctgagagagaggagttctcaaactacttgaacgtcgtcaacaatgacatgactccgtccatctacggtgagattaggggtgacatattgcccagaaacccgtaccttatcttggaagaagacccgtacagcaagacgatcaacccaccgaaccaggcccagagagcagccaacttgatcaactcgagtttgaagttcattattacgttgaggaacgagacgttgaagccagatgtcactccaaagcacggaaacccgttgacgatgaagtgctacaggaacttgtttggcacgacgaggatcccggaatttgaagagcacaaccacgacatcaagatgagaaagtacgaacacatcaacgactcacgacacattttgattatcgccaacaaccagttctacacattggaagtgatcacggagtacacagaggaggagtaccaggagaccaagtccaagcacaagatctggttcaatgaccatgagctttcgttgatcttgcagcaaatcatagacgagtccaagaaggttgacgccgtcaagtccatcaacaactccattgggtcgttgaccacgcagacgttgaagcattggaagttggctaggttggagttggagcagtcgaatctggaaaacatcaagaagattgacgatgcgttgtttgtcgtgattttggactctaacgcaccagaaactgacggagagaaaacggcggtgatttcccacggtacgtccgtgttgtcagcggacaacgtgcaggttggtacctgtacctcgcgttggtacgataagttgcagttgattgtcacccagaactccgttgctggtgtggtgtgggaatccatgtcgatggacagtactgctattttgagattcatcagtgatatctacaccgactcggtgttgaagttggccaagaacatcaacgggtccgagtacactttgtttgactccaatattgtgtttgcgtcttcttcaatcagcaagccggaagccgtcatgatctatttcaacaaaacaaaggagttgcagaacattatccatctttcggaaaccagattggctgacttgatcaaccaacacgagtacatgacgcaccgtatcaagttggattcgtacttgacgagcaagtttaacctttccgtggactccatcatgcaggtgtgtttccagattgcttattactcgttgtacggtagagttgtcaacacgttggagccaatcaccaccagaaaattcaaggacgccagaaccgagttgatcccggttcagaatgaagttcttggcaacttggtcaagctctacatcaccagcgccagtgcactggagaagtttgaagcattcaagaaatgttgtgagttgcacacccaccagtaccacgatgccatgattggtaaaggtttcgaaagacacttgatgacgatcatccaagtgatcaagaaaccgaaagctgtggtcagattaaacgaacttaacagccacttgccgccaattcctgacttgaccaaggaaccagtgaccattccgttattgctaaacccagccattgacaagttactgagccccgagttgttgatttccaactgcggtaatcctgcattgagattgtttggtatcccgccagccatcgaccaagggtttggtattgggtacattatccaccgcgacaaggtgttgatcactgtttgttccaagcacagacaaacggaaaggttcttggacactttccaccgtgttgttcgtgatttgaaggtcaacttgagacaaaagagcaactttttgnnnnnnnnnngatcagtgactcggaacaaagaaaacacgagttgcagaggttgcgaatcgagcatgagt

SEQ ID NO: 89 - DNA, 1953 bp, Candida sp.
atgtcaggattagaaatagccgctgctgccatccttggtagtcagttattggaagccaaatatttaattgccgacgacgtgctgttagccaagacagtcgctgtcaatgccctcccatacttgtggaaagccagcagaggtaaggcatcatactggtactttttcgagcagtccgtgttcaagaacccaaacaacaaagcgttggcgttcccaagaccaagaaagaatgcccccacccccaagaccgacgccgagggattccagatctacgacgatcagtttgacctagaagaatacacctacaaggaattgtacgacatggttttgaagtactcatacatcttgaagaacgagtacggcgtcactgccaacgacaccatcggtgtttcttgtatgaacaagccgcttttcattgtcttgtggttggcattgtggaacattggtgccttgcctgcgttcttgaacttcaacaccaaggacaagccattgatccactgtcttaagattgtcaacgcttcgcaagttttcgttgacccggactgtgattccccaatcagagataccgaggctcagatcagagaggaattgccacatgtgcaaataaactacattgacgagtttgccttgtttgacagattgagactcaagtcgactccaaaacacagagccgaggacaagaccagaagaccaaccgatactgactcctccgcttgtgcattgatttacacctcgggtaccaccggtttgccaaaagccggtatcatgtcctggagaaaagccttcatggcctcggttttctttggccacatcatgaagattgactcgaaatcgaacgtcttgaccgccatgcccttgtaccactccaccgcggccatgttggggttgtgtcctactttgattgtcggtggctgtgtctccgtgtcccagaaattctccgctacttcgttctggacccaggccagattatgtggtgccacccacgtgcaatacgtcggtgaggtctgtcgttacttgttgaactccaagcctcatccagaccaagacagacacaatgtcagaattgcctacggtaacgggttgcgtccagatatatggtctgagttcaagcgcagattccacattgaaggtatcggtgagttctacgccgccaccgagtcccctatcgccaccaccaacttgcagtacggtgagtacggtgtcggcgcctgtcgtaagtacgggtccctcatcagcttgttattgtctacccagcagaaattggccaagatggacccagaagacgagagtgaaatctacaaggaccccaagaccgggttctgtaccgaggccgcttacaacgagccaggtgagttgttgatgagaatcttgaaccctaacgacgtgcagaaatccttccagggttattatggtaacaagtccgccaccaacagcaaaatcctcaccaatgttttcaaaaaaggtgacgcgtggtacagatccggtgacttgttgaagatggacgaggacaaattgttgtactttgtcgacagattaggtgacactttccgttggaagtccgaaaacgtctccgccaccgaggtcgagaacgaattgatgggctccaaggccttgaagcagtccgtcgttgtcggtgtcaaggtgccaaaccacgaaggtagagcctgttttgccgtctgtgaagccaaggacgagttgagccatgaagaaatcttgaaattgattcactctcacgtgaccaagtctttgcctgtgtatgctcaacctgcgttcatcaagattggcaccattgaggcttcgcacaaccacaaggttcctaagaaccaattcaagaaccaaaagttgccaaagggtgaagacggcaaggatttgatctactggttgaatggcgacaagtaccaggagttgactgaagacgattggtctttgatttgtaccggtaaagccaaattgtag

SEQ ID NO: 90 - protein, 650 aa, Candida sp.; identical to SEQ ID NO: 42

SEQ ID NO: 91 - DNA, 2208 bp, Candida sp.
atggtcaacatatcgaaattgacgggttataacaagcaggacatcaggaatgtggtgctattgctacaggagtttgtcaagacctacaaagacaacaagatcaaactcaactacctgagtagacctgtcatcttgttcttgagtaccttggttgcaactgccggtattggggtgtttttcaccttgagaagcatcgtcactaagtacaacgagtacctactcaacaagagattgagacgcccaagtcttatcagacaatcctccaatatcttgaagaacggatcccgtgagatctttatccagaagggcaacggcaaagtaacaagaatcatcatcccaaaagcaaacaacgaccagtatgccgccgacaagtatttgtataaagattttgcccgcaacgagcaaatattgcaacagcaaaagggaaggctcttcaattccagattcttgaaccagttgaccattatctggaagatcttgattccaaagttctactgccaaaacacttccttgttgttatcgcagtgcttctttttgattttcagaacatggttgtccttgttgattgccaagctagatggtcagattgtcaagaacttgattgctgcagacggtaggaagtttgcccgtgacttgatttactttttgttgattgccttccctgcttcgtacaccaacgccgctatcaaatacttggaattgagattggcgttaggattcagaactaatcttaccagatacatccatgacatgtacttggacaaaaccatgtcgtactacaaagtgggattgaacggcgccgatatccaaaacatagaccagtacatcaccgaagatgtcaccaaattctgtatgtcgttgtgttcgttgttttcctccatgggtaagccattcattgacttgatctttttcagtgtttatttgagagacaatttgggtactggtgccattattggcatttttgccaactattttgctaccgccatcatgttgaaaaaggcaacaccaagattcggtaagttggctgccaaaagaacccacttggaaggtgtttatttcaaccaacagttgaacataatgaccaacagtgaagagattgggttctacaaaggatcgaagattgagaagtccaagcttgcggagaactttgacaagttgatgggtcacgtatcgagagaaatcaatttatcgtccagctatgccgctctagaagactacgtgcttaaatacacgtggctggcctggggttacatcttttctggtctacctgtgtttttggatgtgcttttccctaaagaagacccaagtagtggccatattgctgatatagatgacgatgaccatgcccatggacacgggcacaccggggaagagaccagctcaacaactgaaaacatgaagaccttcgtcaccaacaagcgattattgttgagtcttgccgatgctggttccagattgatggttagtttgaaagaggtcaccacgttgacaggtataacgaatagagtcttcaacatgttgactcagctccaccgtgtccatgatcctaaatttgactacggtgacaagtatggtttgcctgatattcacgggacttatcaattgaactacgatggtttgagattggaacatgttccaattactgtgccaactgccgagggttcttactccacaccattgatcccagacctcacttttgacatcaagggcaagaatttgttatttgttggtccaaacggttcgggcaaaacttctgttgccagggttcttgcaggtctttggcccttgtatgccgggttagtgctgaaaccactggatttgttctttaacccacaaaagagttatttcaccaccggaagtttgcgtgaccaagttgtttaccctaatagatccgaaaacaccaccaacgatcaaattttccacatcttacactgtgtacacttagaccatattgttaaacggtacggattgaaccagaacttggatttcgctaaaacattgagtggaggtgagaagcaaagattgagtttcgccagagtgttgtttaacagaccaagtattgtcattcttgatgattcgacgtcggcgttgtccccagatatggaagagttgatgtaccaggtgttgcaagatcacaagatcaattacgtcacactttcaaatcgtccctctctcagtaagttccatgataaagtatttgaaatataa

SEQ ID NO: 92 - protein, 735 aa, Candida sp.
MVNISKLTGYNKQDIRNVVLLLQEFVKTYKDNKIKLNYSSRPVILFLSTLVATAGIGVFFTLRSIVTKYNEYLLNKRLRRPSLIRQSSNILKNGSREIFIQKGNGKVTRIIIPKANNDQYAADKYLYKDFARNEQILQQQKGRLFNSRFLNQLTIIWKILIPKFYCQNTSLLLSQCFFLIFRTWLSLLIAKLDGQIVKNLIAADGRKFARDLIYFLLIAFPASYTNAAIKYLELRLALGFRTNLTRYIHDMYLDKTMSYYKVGLNGADIQNIDQYITEDVTKFCMSLCSLFSSMGKPFIDLIFFSVYLRDNLGTGAIIGIFANYFATAIMLKKATPRFGKLAAKRTHLEGVYFNQQLNIMTNSEEIGFYKGSKIEKSKLAENFDKLMGHVSREINLSSSYAALEDYVLKYTWSAWGYIFSGLPVFLDVLFPKEDPSSGHIADIDDDDHAHGHGHTGEETSSTTENMKTFVTNKRLLLSLADAGSRLMVSLKEVTTLTGITNRVFNMLTQLHRVHDPKFDYGDKYGLPDIHGTYQLNYDGLRLEHVPITVPTAEGSYSTPLIPDLTFDIKGKNLLFVGPNGSGKTSVARVLAGLWPLYAGLVSKPSDLFFNPQKSYFTTGSLRDQVVYPNRSENTTNDQIFHILHCVHLDHIVKRYGLNQNLDFAKTLSGGEKQRLSFARVLFNRPSIVILDDSTSALSPDMEELMYQVLQDHKINYVTLSNRPSLSKFHDKVFEI

SEQ ID NO: 93 - DNA, 1998 bp, Candida sp.
atgacagtggagaatgcaaaactacagaagaactcgttggcggttctgctcttgaaggtgtacaaatccaacagatcattattgttaaacacctcatacatcatattaatcattgctgccttcactggcgcaacgaataccgggcgaggcacctcctccagatcatcggcaaaagtagagaccgatgaagaacaatcggttaaaaagaaacaccccaagctctctagagagtccttccatagactaagaaaagcaatcttgccaactttctttgatagaactatagtttactttttcgccaacttgactttgttggtggtcagagcattattgacacttagagttgctacccttgacggtcagcttgtgggggcattggtttcaagaagaataagggtgtttgccaagtacttgttgtactggatgcttcttggtatccccgctgctttgacaaatgccttgttgaactggaccaaactgaacttgagcaagagcattagaatgaacttgaataataacatcatggaggaatacttgccagataacttggacccaaactattattcattgatccatttgactgataacaagattagagacccaaatcagagaataaccactgatactagtcgtttgagcgatgccttggcaagcttgcccggtcacatattgaagccaacgttggatatcatattgtgtgcgcaacagttaagcaagagcggtgttggtaatggggaaggtacgttggcattaggtatattggcacacttctcaaccatgatcatccgtttcttctccccgccatttgccaagttggcggctgagagagctaaccttgaaggtcagttgcgttccgcgcattccaagattgttgccaacagtgaagaaattgctttcttgggtggtcatgaccgtgagttggatcacatcgaccactgctactatactttggagagattctcgaaaggcgaatattggaagcgagccatacacgaaatcacacaaacgtttattgtgaagtacttttggggtgttgcaggtttagtgttgtgttctgcaccggttttcattgccaaatacttgggtgagccggaagataagaatgttgctggtaatttcatcaccaacagaagattgttgatgagtgcctcggattccttggatcgtttaatctattctagaagatacttgttgcaagttgtcggtcatgctaccagagtgtctgacttcttggacactttacatgaagtggaggagaagaagaagagaatcacatcgaatgtgcagtttaacaacgacgagattactttcgatcatgttagattgatgactccaacggaagtgaccttgatcccagacttgaacttttccattaaaccaggtgaccatttgttgattgtggggccaaacggttcaggtaagtcgtcgttgttcagaatgttgggtgggttgtggcccgttaggtttggtactattagaattccaaacacagagaacatgttctacttgccgcaaaaggcttaccttgttgaaggatcattcagagagcaaatcatttatccacacaacgtgactcaacagaagaagactgatcaacaattgaaagagatcttgaaggttttgaaattggaagattactcagggcaattggatgaggttaagaaatggagcgaagaattgtccattggtgctcaacaaagattggctatggctagattgtactaccacgaacctaagtttgctgtcttggacgaatgtacttcagctgtgtcaccagacatggaacaactcatgtaccaacacgcacaaggtttgggtatcacgcttttgtccgttgcccatagacctgcattgtggcacttccacaaatacttgttggaattcgacgggaagggtagttactactttggtacgttggatgaaaagcacaaaatgaagttagaagaagaagaacgactcaagaaggagaatgaaaagaagagtgtcgccaagaagtag

SEQ ID NO: 94 - protein, 665 aa, Candida sp.
MTVENAKLQKNSLAVSLLKVYKSNRSLLLNTSYIILIIAAFTGATNTGRGTSSRSSAKVETDEEQSVKKKHPKLSRESFHRLRKAILPTFFDRTIVYFFANLTLLVVRALLTLRVATLDGQLVGALVSRRIRVFAKYLLYWMLLGIPAALTNALLNWTKSNLSKSIRMNLNNNIMEEYLPDNLDPNYYSLIHLTDNKIRDPNQRITTDTSRLSDALASLPGHILKPTLDIILCAQQLSKSGVGNGEGTLALGILAHFSTMIIRFFSPPFAKLAAERANLEGQLRSAHSKIVANSEEIAFLGGHDRELDHIDHCYYTLERFSKGEYWKRAIHEITQTFIVKYFWGVAGLVLCSAPVFIAKYLGEPEDKNVAGNFITNRRLLMSASDSLDRLIYSRRYLLQVVGHATRVSDFLDTLHEVEEKKKRITSNVQFNNDEITFDHVRLMTPTEVTLIPDLNFSIKPGDHLLIVGPNGSGKSSLFRMLGGLWPVRFGTIRIPNTENMFYLPQKAYLVEGSFREQIIYPHNVTQQKKTDQQLKEILKVLKLEDYSGQLDEVKKWSEELSIGAQQRLAMARLYYHEPKFAVLDECTSAVSPDMEQLMYQHAQGLGITLLSVAHRPALWHFHKYLLEFDGKGSYYFGTLDEKHKMKLEEEERLKKENEKKSVAKK

SEQ ID NO: 95 - DNA, 696 bp, Candida sp.
atggtcgccgattctttagtctaccacccaaccgtctccaaattagtcaagttcttggacacaaccccaaagagggaaaaggtcttcagattattgtcctacttgtccagattcttgggctactacgcctacagaaagggctactccaaggaaaccatcgcccttttcgccaacttgaaaggaaacttcacattcatcagaaaggccatgagattcttgaagccaataaatcacttgcaattggcctccaaggcatacgacaacaagttgttggacccagtcttgcagatcaccaccatcatcagaaacttggcctacgccggctacttgaccatcgacggtgtcatattcttcaagttgttgggtctcattgacgccaagaagttccctaacttggctacatacgcctccagattctggttgatcgggttgattgccggtttgatcaactccttgagaatcatctactccttgaaggactacgagcaccaggagggcgacaaggagaaggagaccgacgctaaggctatccacactaagttgtacgccgctaagagaaaattggtctgggacttgttggatacttttattgctttgaactccttggacatcttgcatttcaccgagggtgacgtcgggttcgctggtactatcacctccctcttgggattggaagacttgtggaaggccacttaa

SEQ ID NO: 96 - protein, 231 aa, Candida sp.
MVADSLVYHPTVSKLVKFLDTTPKREKVFRLLSYLSRFLGYYAYRKGYSKETIALFANLKGNFTFIRKAMRFLKPINHLQLASKAYDNKLLDPVLQITTIIRNLAYAGYLTIDGVIFFKLLGLIDAKKFPNLATYASRFWLIGLIAGLINSLRIIYSLKDYEHQEGDKEKETDAKAIHTKLYAAKRKLVWDLLDTFIALNSLDILHFTEGDVGFAGTITSLLGLEDLWKAT

SEQ ID NO: 97 - protein, 525 aa, Candida sp.
MFEDRLMAASGLDVPIILEDSPFFKTEMKPSTSYNITLLTIGSRGDVQPYMALGKGLVKEGHNVTIATHGEFGDWIKKSGLNFKEIAGNPAELMSFMVTHNTMSVGFLKDAQKKFKSWIATLLTTSWKACQGSDILIESPSAMAGIHIAEALGIPYFRAFTMPWTRTRAYPHAFFVPDQKKGGSYNYLTHVLFENIFWKGISGQVNKWRVQELDLPKTNLYRLQQTRVPFLYNVSLTVLPPAVDFPDWIKVTGYWFLDEGSGDYKPPEELVKFMSDAAADGKKIVYIGFGSIVVKDAKSLTKAVVEAVKRADVRCILNKGWSDRLDKKGKDDIEVELPPEVYNSGAIPHDWLFPRVDAAVHHGGSGTTGASLRAGTPTIIKPFFGDQFFYATRVEDLGAGLGLKKLTAKTLANALVTVTEDLKIIEKAKRVSEQIKHEHGVLSAIEAIYSELEYSRNLILVKDIYNQNYKRHHPDFRSQSGIQSPVEPSDDEDEEDEEEEDSNEDDDEDNEDYEDESSDQRSKAS

SEQ ID NO: 98 - DNA, 1578 bp, Candida sp.
atgtttgaagacagattgatggctgcgtctggtttggatgttcctattatcttggaagactcgccattctttaagacagaaatgaagccatcaacctcttacaatatcacgttgttgactattgggtcgcgaggtgatgtgcaaccatacatggctttaggtaaaggcttagttaaagagggccacaatgttactatcgctactcacggagagttcggagactggatcaagaagagtggattgaactttaaagaaattgctggtaatcctgccgagttgatgtcgtttatggttacccacaacaccatgtctgttggtttccttaaggatgcccagaagaagttcaaatcctggattgccacgttgttgactaccagttggaaggcgtgtcaaggttctgatatcttgattgaaagtccttcagccatggccggtatccacattgccgaagccttaggcattccttatttcagagcattcacgatgccatggactagaactagagcgtacccgcatgcattctttgtgcctgatcaaaagaagggtggttcatacaattatttgacacatgtcttgtttgaaaatatcttctggaaaggtatttctggacaggttaacaagtggagagtgcaagagttggatttgcccaagaccaacttgtacagattgcagcaaacgagagtgccgttcttgtacaatgtctcgctcactgttttgccaccggccgttgacttccccgattggattaaagtcactggttactggtttttggatgaaggttctggtgattacaaacctcctgaagagcttgtcaagtttatgagtgatgccgctgctgatggcaaaaagattgtctacattggatttggttccattgttgttaaggacgccaagtcgttgacgaaagctgttgttgaagctgttaagcgtgccgacgtccgttgtatcttgaacaaaggttggtccgacaggctagacaagaagggtaaggacgatatcgaagttgagttaccgccagaagtgtacaactcgggtgctatccctcatgattggttgttcccacgtgtcgacgcagctgtacaccacggtggttctggtaccactggtgctagtttgcgtgctggtacacctactattatcaaaccattctttggagaccaatttttctacgccacgcgagttgaagatttaggcgccgggttggggttgaaaaaattgactgcaaaaacgttggcaaacgcgcttgttaccgttaccgaagacttgaagattattgaaaaggcaaagagagtcagcgagcaaatcaaacacgagcatggtgttctcagtgccatcgaagctatctactcagagttagagtactccaggaacttgatcttggtgaaggatatctacaaccagaactacaagcgtcaccacccagatttcagatcacaatctggtattcaatcgccagttgagcctagcgatgacgaggacgaagaagacgaagaagaagaagacagcaatgaagacgacgatgaggacaatgaagattatgaagacgagtcatcagaccagcggtcaaaggcttcatag

SEQ ID NO: 99 - DNA, 1239 bp, Saccharomyces cerevisiae
atgacaaagattaaggtagctaaccccattgtggaaatggacggcgatgagcaaacaagaataatctggcatttaatcagggacaagttagtcttgccctatcttgacgttgatttgaagtactacgatctttccgtggagtatcgtgaccagactaatgatcaagtaactgtggattctgccaccgcgactttaaagtatggagtagctgtcaaatgcgcgactattacacccgatgaggcaagggtcgaggaatttcatttgaaaaagatgtggaaatctccaaatggtactattagaaacattttgggtggtacagtgttcagagaacctattattatccctagaattccaaggctagttcctcaatgggagaagcccatcatcattgggagacacgcattcggcgatcagtacaaagctaccgatgtaatagtccctgaagaaggcgagttgaggcttgtttataaatccaagagcggaactcatgatgtagatctgaaggtatttgactacccagaacatggtggggttgccatgatgatgtacaacactacagattcgatcgaagggtttgcgaaggcctcctttgaattggccattgaaaggaagttaccattatattccactactaagaatactattttgaagaagtatgatggtaaattcaaagatgttttcgaagccatgtatgctagaagttataaagagaagtttgaatcccttggcatctggtacgagcaccgtttaattgatgatatggtggcccaaatgttgaaatctaaaggtggatacataattgccatgaaaaattacgacggtgacgtagaatcagatattgttgcacaaggatttggctccttggggttaatgacatctgtgttgattaccccggacggtaaaacctttgaaagcgaagccgcccacggtacagtaacaagacattttagacagcatcagcaaggaaaggagacgtcaacaaattccattgcatcaattttcgcgtggactagaggtattattcaaaggggtaaacttgataatactccagatgtagttaagttcggccaaatattggaaagcgctacggtaaatacagtgcaagaagatggaatcatgactaaagatttggcgctcattctcggtaagtctgaaagatccgcttatgtcactaccgaggagttcattgacgcggtggaatctagattgaaaaaagagttcgaggcagctgcattgtaa

SEQ ID NO: 100 - protein, 412 aa, Saccharomyces cerevisiae
MTKIKVANPIVEMDGDEQTRIIWHLIRDKLVLPYLDVDLKYYDLSVEYRDQTNDQVTVDSATATLKYGVAVKCATITPDEARVEEFHLKKMWKSPNGTIRNILGGTVFREPIIIPRIPRLVPQWEKPIIIGRHAFGDQYKATDVIVPEEGELRLVYKSKSGTHDVDLKVFDYPEHGGVAMMMYNTTDSIEGFAKASFELAIERKLPLYSTTKNTILKKYDGKFKDVFEAMYARSYKEKFESLGIWYEHRLIDDMVAQMLKSKGGYIIAMKNYDGDVESDIVAQGFGSLGLMTSVLITPDGKTFESEAAHGTVTRHFRQHQQGKETSTNSIASIFAWTRGIIQRGKLDNTPDVVKFGQILESATVNTVQEDGIMTKDLALILGKSERSAYVTTEEFIDAVESRLKKEFEAAAL

SEQ ID NO: 101 - protein, 640 aa, Saccharomyces cerevisiae
MWPIQQSRLYSSNTRSHKATTTRENTFQKPYSDEEVTKTPVGSRARKIFEAPHPHATRLTVEGAIECPLESFQLLNSPLFNKGSAFTQEEREAFNLEALLPPQVNTLDEQLERSYKQLCYLKTPLAKNDFMTSLRVQNKVLYFALIRRHIKELVPIIYTPTEGDAIAAYSHRFRKPEGVFLDITEPDSIECRLATYGGDKDVDYIVVSDSEGILGIGDQGIGGVRIAISKLALMTLCGGIHPGRVLPVCLDVGTNNKKLARDELYMGNKFSRIRGKQYDDFLEKFIKAVKKVYPSAVLHFEDFGVKNARRLLEKYRYELPSFNDDIQGTGAVVMASLIAALKHTNRDLKDTRVLIYGAGSAGLGIADQIVNHMVTHGVDKEEARKKIFLMDRRGLILQSYEANSTPAQHVYAKSDAEWAGINTRSLHDVVENVKPTCLVGCSTQAGAFTQDVVEEMHKHNPRPIIFPLSNPTRLHEAVPADLMKWTNNNALVATGSPFPPVDGYRISENNNCYSFPGIGLGAVLSRATTITDKMISAAVDQLAELSPLREGDSRPGLLPGLDTITNTSARLATAVILQALEEGTARIEQEQVPGGAPGETVKVPRDFDECLQWVKAQMWEPVYRPMIKVQHDPSVHTNQL

SEQ ID NO: 102 - DNA, 1923 bp, Saccharomyces cerevisiae
atgtggcctattcagcaatcgcgtttatattcttctaacactagatcgcataaagctaccacaacaagagaaaatactttccaaaagccatacagcgacgaggaggtcactaaaacacccgtcggttctcgcgccagaaagatcttcgaagctcctcacccacatgccactcgtttgactgtagaaggtgccatagaatgtcccttggagagctttcaacttttaaactctcctttatttaacaagggttctgcatttacacaagaagaaagggaagcgtttaatttagaagcattgctaccaccacaagtgaacactttggacgaacaactggaaagaagctacaagcagttatgctatttgaagacgcccttggccaaaaacgacttcatgacgtctttgagagtacagaacaaagtcctatattttgcattaataaggagacatatcaaggaattagttcctatcatttacaccccaaccgaaggtgatgctattgctgcctattcccacaggttcagaaagccagaaggtgtgtttttagacattaccgaacctgattccatcgaatgtagattggctacatacggtggagacaaagatgtagactacatcgttgtgtcggattcggaaggtattctgggaattggtgaccaaggtatcggtggtgtacgtattgctatctccaaattggcattgatgacgctgtgcggtggtattcatcccggccgtgtgctacctgtgtgtttggacgtcggtactaacaacaagaaactagcccgtgacgaattgtacatgggtaacaagttctccagaatcaggggtaagcaatatgacgacttcttggaaaaattcatcaaggccgttaagaaagtgtatccaagcgccgttctgcatttcgaagatttcggtgttaagaacgctagaagattactagaaaagtacaggtacgaattgccatcattcaacgatgacattcagggcaccggtgccgtcgtgatggcctcgttgattgctgctttgaaacataccaacagagacttgaaagacaccagagtgcttatttacggtgccgggtctgcgggcctcggtatcgcagatcaaattgtgaatcatatggtcacgcacggcgttgacaaggaagaagcgcgcaagaaaatcttcttgatggacagacgtgggttaattctacaatcttacgaggctaactccactcccgcccaacacgtatacgctaagagtgatgcggaatgggctggtatcaacacccgctctttacatgatgtggtggagaacgtcaaaccaacgtgtttggttggctgctccacacaagcaggcgcattcactcaagatgtcgtagaagaaatgcacaagcacaatcctagaccgatcattttcccattatccaaccctactagactacacgaagccgttcctgccgatttaatgaagtggaccaacaacaacgctcttgtagctaccggatctcctttcccacctgttgatggttaccgtatctcggagaacaacaattgttactctttcccaggtatcggtttaggtgccgtactatcgcgtgccaccaccatcacagacaagatgatctccgctgcagtggaccaactagccgaattgtcgccactaagagagggcgactcgagacctgggttgctacccggcctggacaccatcaccaacacttctgcgcgtctagctaccgctgtgatcttgcaagcactcgaggagggaaccgcccgtatcgagcaagaacaagtaccgggaggagctcccggcgaaactgtcaaggttcctcgtgactttgacgaatgtttacagtgggtcaaagcccaaatgtgggagcctgtgtacagacctatgatcaaggtccaacatgacccatcggtgcacaccaaccaattgtag

SEQ ID NO: 103 - protein, 671 aa, Candida sp.
  MOD_RES (203)..(205): Any amino acid
MLKFNKISARFVSSTATASATSGEMRTVKTPVGIKAAIESLKPKATRVSMDGPVECPLTDFALLNSPQFNKGSAFSLEERKSFKLTGLLPSQVNTLDEQVERAYRQFTYLKTPLAKNDFCTSMRLQNKVLYYELVRRNIREMLPIIYTPTEGDAIASYSDRFRKPEGCFLDINDPDNIDERLAAYGENKDIDYIVMSDGEGIXXXSDRFRKPEGCFLDINDPDNIDERLAAYGENKDIDYIVMSDGEGILGIGDQGVGGIRIAIAKLGLMTLCGGIHPARVLPITLDVGTNNDRLLNDDLYMGNKFPRVRGERYWDFVDKVIHAITKRFPSAVMHYEDFGVTTGRDMLHKYRTALPSFNDDIQGTGAVVMASITAALKFSNRSLKDIEVLIYGAGSAGLGIADQITNHLVSHGATPEQARSRIHCMDRYGLITTESNNASPAQMNYADKASDWEGVDTSSLLACVEKVKPTVLVGCSTQAGAFTEEVVKTMYKYNPQPIIFPLSNPTRLHEAVPADLMKWTDNNALIATGSPFEPVDGYYISENNNCFTFPGIGLGAVLSRCSTISDTMISAAVDRLASMSPKMENPKNGLLPRLEEIDEVSAHVATAVILQSLKEGTARVESEKKPDGGYVEVPRDYDDCLKWVQSQMWKPVYRPYIKVEYVSNIHTYQY

SEQ ID NO: 104 - DNA, 2013 bp, Candida sp.
  modified_base (607)..(614): a, c, t, g, unknown or other
atgctcaaattcaataaaatactggccagattcgtctcctccacggccaccgcatccgccacgtcaggggaaatgcgtaccgtcaagaccccagtggggatcaaggcggccatcgaatcattaaaaccaaaagctactagagtctccatggacggacctgtcgaatgcccattgaccgatttcgccttgttgaactcccctcaattcaacaaaggttcggcattttctttggaagaaaggaaaagtttcaagttgaccgggctcctcccttctcaagtcaacactttggatgaacaggttgaaagagcctatagacaattcacatacttgaagaccccattggccaagaacgatttctgcacgtctatgagattgcagaacaaagtgctttactacgagttggttagaagaaatatccgtgagatgttgcccatcatctacaccccaaccgaaggggacgccatcgccagttattccgacaggttcagaaaaccagagggctgtttcttggatatcaacgaccccgacaacatcgatgagagattagctgcctatggggagaacaaagacatagattacattgtcatgagtgacggagaaggtatcnnnnnnnnctccgacaggttcagaaaaccagagggctgcttcttggacatcaatgacccagacaacatcgacgagagattggctgcctatggggagaacaaagacatagattacattgtcatgagtgacggagaaggtatcctcggtattggagaccaaggcgtcggtggtatcagaattgccattgctaaattggggttgatgaccctttgtggtggtattcacccggccagagttttgcccatcactttggatgttggtacaaataacgacaggttgttgaatgatgatttgtacatgggcaacaagttccctagagtcagaggagaaagatactgggactttgtcgataaggtcatacacgcaattacgaaacggttcccaagtgccgtgatgcattacgaagatttcggagtcacaactggtagggacatgttgcacaagtaccgtacggctcttccttctttcaacgacgacatccaaggtaccggtgcagttgtcatggcatcgatcacagctgccttgaagttctccaaccgtagcctaaaggacatcgaggttttgatttacggtgccggctcagctggtttaggtattgctgaccagatcaccaaccacttggtcagccacggcgctactccagaacaagccagatctaggatccattgtatggaccgttatgggttgatcacaactgaatccaacaacgccagtcctgctcaaatgaactacgccgacaaggcatctgattgggaaggtgtcgatacctcgagtctacttgcctgtgttgagaaagtcaaaccaactgtcttggttgggtgttccactcaggcaggtgcattcaccgaagaggttgtcaaaaccatgtacaagtacaacccacagccaattattttcccattgtccaaccctaccagattgcatgaagccgtgccggctgatttgatgaaatggaccgacaacaacgcgttgattgccaccggttctccatttgaacctgtcgatggctactacatttccgaaaacaacaactgtttcaccttcccaggtattgggttgggtgctgtcttgtccagatgtagcaccatttcggataccatgatttctgccgccgttgatagattggcttcgatgtcgccaaagatggagaacccaaagaacggattgttgcctagattggaagaaatcgacgaagtcagtgcccatgttgccacggctgttatcttgcaatctttgaaggaaggcaccgctagagtcgaaagcgagaagaagccagacggtggttacgttgaagttccaagagactatgatgattgtcttaagtgggtgcaatcacaaatgtggaagccagtgtacagaccatacatcaaggttgagtacgtttcgaatattcacacctatcaatat

SEQ ID NO: 105 - protein, 669 aa, Saccharomyces cerevisiae
MLRTRLSVSVAARSQLTRSLTASRTAPLRRWPIQQSRLYSSNTRSHKATTTRENTFQKPYSDEEVTKTPVGSRARKIFEAPHPHATRLTVEGAIECPLESFQLLNSPLFNKGSAFTQEEREAFNLEALLPPQVNTLDEQLERSYKQLCYLKTPLAKNDFMTSLRVQNKVLYFALIRRHIKELVPIIYTPTEGDAIAAYSHRFRKPEGVFLDITEPDSIECRLATYGGDKDVDYIVVSDSEGILGIGDQGIGGVRIAISKLALMTLCGGIHPGRVLPVCLDVGTNNKKLARDELYMGNKFSRIRGKQYDDFLEKFIKAVKKVYPSAVLHFEDFGVKNARRLLEKYRYELPSFNDDIQGTGAVVMASLIAALKHTNRDLKDTRVLIYGAGSAGLGIADQIVNHMVTHGVDKEEARKKIFLMDRRGLILQSYEANSTPAQHVYAKSDAEWAGINTRSLHDVVENVKPTCLVGCSTQAGAFTQDVVEEMHKHNPRPIIFPLSNPTRLHEAVPADLMKWTNNNALVATGSPFPPVDGYRISENNNCYSFPGIGLGAVLSRATTITDKMISAAVDQLAELSPLREGDSRPGLLPGLDTITNTSARLATAVILQALEEGTARIEQEQVPGGAPGETVKVPRDFDECLQWVKAQMWEPVYRPMIKVQHDPSVHTNQL

SEQ ID NO: 106 - DNA, 2010 bp, Saccharomyces cerevisiae
atgcttagaaccagactatccgtttccgttgctgctagatcgcaactaaccagatccttgacagcatcaaggacagcaccattaagaagatggcctattcagcaatcgcgtttatattcttctaacactagatcgcataaagctaccacaacaagagaaaatactttccaaaagccatacagcgacgaggaggtcactaaaacacccgtcggttctcgcgccagaaagatcttcgaagctcctcacccacatgccactcgtttgactgtagaaggtgccatagaatgtcccttggagagctttcaacttttaaactctcctttatttaacaagggttctgcatttacacaagaagaaagggaagcgtttaatttagaagcattgctaccaccacaagtgaacactttggacgaacaactggaaagaagctacaagcagttatgctatttgaagacgcccttggccaaaaacgacttcatgacgtctttgagagtacagaacaaagtcctatattttgcattaataaggagacatatcaaggaattagttcctatcatttacaccccaaccgaaggtgatgctattgctgcctattcccacaggttcagaaagccagaaggtgtgtttttagacattaccgaacctgattccatcgaatgtagattggctacatacggtggagacaaagatgtagactacatcgttgtgtcggattcggaaggtattctgggaattggtgaccaaggtatcggtggtgtacgtattgctatctccaaattggcattgatgacgctgtgcggtggtattcatcccggccgtgtgctacctgtgtgtttggacgtcggtactaacaacaagaaactagcccgtgacgaattgtacatgggtaacaagttctccagaatcaggggtaagcaatatgacgacttcttggaaaaattcatcaaggccgttaagaaagtgtatccaagcgccgttctgcatttcgaagatttcggtgttaagaacgctagaagattactagaaaagtacaggtacgaattgccatcattcaacgatgacattcagggcaccggtgccgtcgtgatggcctcgttgattgctgctttgaaacataccaacagagacttgaaagacaccagagtgcttatttacggtgccgggtctgcgggcctcggtatcgcagatcaaattgtgaatcatatggtcacgcacggcgttgacaaggaagaagcgcgcaagaaaatcttcttgatggacagacgtgggttaattctacaatcttacgaggctaactccactcccgcccaacacgtatacgctaagagtgatgcggaatgggctggtatcaacacccgctctttacatgatgtggtggagaacgtcaaaccaacgtgtttggttggctgctccacacaagcaggcgcattcactcaagatgtcgtagaagaaatgcacaagcacaatcctagaccgatcattttcccattatccaaccctactagactacacgaagccgttcctgccgatttaatgaagtggaccaacaacaacgctcttgtagctaccggatctcctttcccacctgttgatggttaccgtatctcggagaacaacaattgttactctttcccaggtatcggtttaggtgccgtactatcgcgtgccaccaccatcacagacaagatgatctccgctgcagtggaccaactagccgaattgtcgccactaagagagggcgactcgagacctgggttgctacccggcctggacaccatcaccaacacttctgcgcgtctagctaccgctgtgatcttgcaagcactcgaggagggaaccgcccgtatcgagcaagaacaagtaccgggaggagctcccggcgaaactgtcaaggttcctcgtgactttgacgaatgtttacagtgggtcaaagcccaaatgtgggagcctgtgtacagacctatgatcaaggtccaacatgacccatcggtgcacaccaaccaattgtag

SEQ ID NO: 107 - protein, 1180 aa, Saccharomyces cerevisiae
MSSSKKLAGLRDNFSLLGEKNKILVANRGEIPIRIFRSAHELSMRTIAIYSHEDRLSMHRLKADEAYVIGEEGQYTPVGAYLAMDEIIEIAKKHKVDFIHPGYGFLSENSEFADKVVKAGITWIGPPAEVIDSVGDKVSARHLAARANVPTVPGTPGPIETVQEALDFVNEYGYPVIIKAAFGGGGRGMRVVREGDDVADAFQRATSEARTAFGNGTCFVERFLDKPKHIEVQLLADNHGNVVHLFERDCSVQRRHQKVVEVAPAKTLPREVRDAILTDAVKLAKVCGYRNAGTAEFLVDNQNRHYFIEINPRIQVEHTITEEITGIDIVSAQIQIAAGATLTQLGLLQDKITTRGFSIQCRITTEDPSKNFQPDTGRLEVYRSAGGNGVRLDGGNAYAGATISPHYDSMLVKCSCSGSTYEIVRRKMIRALIEFRIRGVKTNIPFLLTLLTNPVFIEGTYWTTFIDDTPQLFQMVSSQNRAQKLLHYLADLAVNGSSIKGQIGLPKLKSNPSVPHLHDAQGNVINVTKSAPPSGWRQVLLEKGPSEFAKQVRQFNGTLLMDTTWRDAHQSLLATRVRTHDLATIAPTTAHALAGAFALECWGGATFDVAMRFLHEDPWERLRKLRSLVPNIPFQMLLRGANGVAYSSLPDNAIDHFVKQAKDNGVDIFRVFDALNDLEQLKVGVNAVKKAGGVVEATVCYSGDMLQPGKKYNLDYYLEVVEKIVQMGTHILGIKDMAGTMKPAAAKLLIGSLRTRYPDLPIHVHSHDSAGTAVASMTACALAGADVVDVAINSMSGLTSQPSINALLASLEGNIDTGINVEHVRELDAYWAEMRLLYSCFEADLKGPDPEVYQHEIPGGQLTNLLFQAQQLGLGEQWAETKRAYREANYLLGDIVKVTPTSKVVGDLAQFMVSNKLTSDDIRRLANSLDFPDSVMDFFEGLIGQPYGGFPEPLRSDVLRNKRRKLTCRPGLELEPFDLEKIREDLQNRFGDIDECDVASYNMYPRVYEDFQKIRETYGDLSVLPTKNFLAPAEPDEEIEVTIEQGKTLIIKLQAVGDLNKKTGQREVYFELNGELRKIRVADKSQNIQSVAKPKADVHDTHQIGAPMAGVIIEVKVHKGSLVKKGESIAVLSAMKMEMVVSSPADGQVKDVFIKDGESVDASDLLVVLEEETLPPSQKK

SEQ ID NO: 108 - DNA, 3543 bp, Saccharomyces cerevisiae
atgagcagtagcaagaaattggccggtcttagggacaatttcagtttgctcggcgaaaagaataagatcttggtcgccaatagaggtgaaattccgattagaatttttagatctgctcatgagctgtctatgagaaccatcgccatatactcccatgaggaccgtctttcaatgcacaggttgaaggcggacgaagcgtatgttatcggggaggagggccagtatacacctgtgggtgcttacttggcaatggacgagatcatcgaaattgcaaagaagcataaggtggatttcatccatccaggttatgggttcttgtctgaaaattcggaatttgccgacaaagtagtgaaggccggtatcacttggatcggccctccagctgaagttattgactctgtgggtgacaaagtctctgccagacacttggcagcaagagctaacgttcctaccgttcccggtactccaggacctatcgaaactgtgcaagaggcacttgacttcgttaatgaatacggctacccggtgatcattaaggccgcctttggtggtggtggtagaggtatgagagtcgttagagaaggtgacgacgtggcagatgcctttcaacgtgctacctccgaagcccgtactgccttcggtaatggtacctgctttgtggaaagattcttggacaagccaaagcatattgaagttcaattgttggctgataaccacggaaacgtggttcatcttttcgaaagagactgttctgtgcaaagaagacaccaaaaagttgtcgaagtcgctccagcaaagactttgccccgtgaagttcgtgacgctattttgacagatgctgttaaattagctaaggtatgtggttacagaaacgcaggtaccgccgaattcttggttgacaaccaaaacagacactatttcattgaaattaatccaagaattcaagtggagcataccatcactgaagaaatcaccggtattgacattgtttctgcccaaatccagattgccgcaggtgccactttgactcaactaggtctattacaggataaaatcaccacccgtgggttttccatccaatgtcgtattaccactgaagatccctctaagaatttccaaccggataccggtcgcctggaggtctatcgttctgccggtggtaatggtgtgagattggacggtggtaacgcttatgcaggtgctactatctcgcctcactacgactcaatgctggtcaaatgttcatgctctggttctacttatgaaatcgtccgtaggaagatgattcgtgccctgatcgaattcagaatcagaggtgttaagaccaacattcccttcctattgactcttttgaccaatccagtttttattgagggtacatactggacgacttttattgacgacaccccacaactgttccaaatggtatcgtcacaaaacagagcgcaaaaactgttacactatttggcagacttggcagttaacggttcttctattaagggtcaaattggcttgccaaaactaaaatcaaatccaagtgtcccccatttgcacgatgctcagggcaatgtcatcaacgttacaaagtctgcaccaccatccggatggagacaagtgctactggaaaagggaccatctgaatttgccaagcaagtcagacagttcaatggtactctactgatggacaccacctggagagacgctcatcaatctctacttgcaacaagagtcagaacccacgatttggctacaatcgctccaacaaccgcacatgcccttgcaggtgctttcgctttagaatgttggggtggtgctacattcgacgttgcaatgagattcttgcatgaggatccatgggaacgtctgagaaaattaagatctctggtgcctaatattccattccaaatgttattacgtggtgccaacggtgtggcttactcttcattacctgacaatgctattgaccattttgtcaagcaagccaaggataatggtgttgatatatttagagtttttgatgccttgaatgatttagaacaattaaaagttggtgtgaatgctgtcaagaaggccggtggtgttgtcgaagctactgtttgttactctggtgacatgcttcagccaggtaagaaatacaacttagactactacctagaagttgttgaaaaaatagttcaaatgggtacacatatcttgggtattaaggatatggcaggtactatgaaaccggccgctgccaaattattaattggctccctaagaaccagatatccggatttaccaattcatgttcacagtcatgactccgcaggtactgctgttgcgtctatgactgcatgtgccctagcaggtgctgatgttgtcgatgtagctatcaattcaatgtcgggcttaacttcccaaccatcaattaatgcactgttggcttcattagaaggtaacattgatactgggattaacgttgagcatgttcgtgaattagatgcatactgggccgaaatgagactgttgtattcttgtttcgaggccgacttgaagggaccagatccagaagtttaccaacatgaaatcccaggtggtcaattgactaacttgttattccaagctcaacaactgggtcttggtgaacaatgggctgaaactaaaagagcttacagagaagccaattacctactgggagatattgttaaagttaccccaacttctaaggttgtcggtgatttagctcaattcatggtttctaacaaactgacttccgacgatattagacgtttagctaattctttggactttcctgactctgttatggacttttttgaaggtttaattggtcaaccatacggtgggttcccagaaccattaagatctgatgtattgagaaacaagagaagaaagttgacgtgccgtccaggtttagaattagaaccatttgatctcgaaaaaattagagaagacttgcagaacagattcggtgatattgatgaatgcgatgttgcttcttacaatatgtatccaagggtctatgaagatttccaaaagatcagagaaacatacggtgatttatcagttctaccaaccaaaaatttcctagcaccagcagaacctgatgaagaaatcgaagtcaccatcgaacaaggtaagactttgattatcaaattgcaagctgttggtgacttaaataagaaaactgggcaaagagaagtgtattttgaattgaacggtgaattaagaaagatcagagttgcagacaagtcacaaaacatacaatctgttgctaaaccaaaggctgatgtccacgatactcaccaaatcggtgcaccaatggctggtgttatcatagaagttaaagtacataaagggtctttggtgaaaaagggcgaatcgattgctgttttgagtgccatgaaaatggaaatggttgtctcttcaccagcagatggtcaagttaaagacgttttcattaaggatggtgaaagtgttgacgcatcagatttgttggttgtcctagaagaagaaaccctacccccatcccaaaaaaagtaa

SEQ ID NO: 109 - protein, 650 aa, Candida sp.
MSRFLKSTFAKSALAAGAAVGGTIVYLDFIKPKNETHLATTYPAFNKNIPAPPPRESLIENLKKTPQFDVLVIGGGAVGTGTALDAATRGLNVCLLEKTDFGAGTSSKSTKMAHGGVRYLEKAIFQLSRAQLDLVIEALNERGNMLRTAPHLCSVLPIMIPVYNWWQVPYFFAGCKMYDWFAGKQNLRSSTIFTTEQAAAIAPMMDTSNLKAACVYHDGSFNDTRYNVSLAVTAIKNGATVLNYFEVEQLLKDDKGKLYGVKAKDLETNETYEIKATSVVNATGPFADKILEMDEDPKGLPPKVEQPPRMVVPSSGVHIVLPEYYCPTNYGLLDPSTSDGRVMFFLPWQGKVLAGTTDTPLKTVPANPVPTEEEIQDIIKEMQKYLVFPIDRNDVLSAWSGIRPLVRDPSTIPKGQEGSGKTEGLVRSHLLVQSPTGLVTISGGKWTTYREMAQETVDYLVDHFSYGDKKLLPCQTNKLLLVGGENYTKNYSARLIHEYKIPLKLAKHLSHNYGSRAPLVLDLYAESDFNKLPVTLAATKEFEPSEKKANEDNQLSYQSFDEPFTVAELKYSLKYEYPRTPLDFLARRTRLAFLNAREALNAVDGVVEIMSQEYGWDKETEDRLRKEARQYIGNMGISPKKFDVEKIVIQ

SEQ ID NO: 110 - DNA, 1950 bp, Candida sp.
atgtcaagattcttaaagtcaacctttgcaaagtcagccttagctgctggtgctgcagtcggtggtaccatcgtgtacttggatttcatcaagccaaagaacgaaacccacttggccactacctacccagccttcaacaagaacataccagctcctcccccacgtgagtccttgatcgaaaacttgaagaagactcctcaattcgacgtcttggtcattggtggtggtgcagttggtaccggtactgctctcgacgctgccacgcgtgggttaaatgtgtgtcttttggaaaaaaccgacttcggtgcaggaacttcgtcgaagtccaccaaaatggcccacggtggtgtccgttacttggagaaggccatttttcaattgtccagagcccaattggacttggtcattgaagccttgaacgaaagaggtaacatgttgagaactgctcctcacttgtgctctgttttgccaatcatgattccagtctacaactggtggcaggttccttactttttcgctggttgtaagatgtacgattggtttgccggtaagcaaaacttgcgttcctccactatcttcaccactgaacaggctgccgctattgccccaatgatggatacttctaacttgaaagccgcctgtgtctaccacgatggtagtttcaacgataccagatacaacgtctccttggctgtcaccgccatcaagaacggcgccactgtcttgaactatttcgaagttgagcaattgttgaaagatgacaagggtaagttgtacggtgtcaaggccaaggatttggaaaccaacgagacctacgagatcaaagccactagtgttgtcaacgctaccggtcctttcgctgataagatcttggagatggacgaagatccaaagggtttgcctccaaaggtcgagcaaccaccaagaatggttgttccatcttccggtgtccacattgttttgcctgaatactactgcccaaccaactacggtttgttagacccatccacctccgacggtagagtcatgttctttttgccatggcaaggtaaggtcttggctggtaccactgatactccattgaagactgttcctgccaaccctgttccaactgaggaagaaatccaagacatcatcaaagaaatgcaaaagtaccttgttttcccaatcgacagaaacgacgttttgtctgcttggtccggtatcagaccattggttagagacccatctactattccaaagggccaagaaggctctggtaagactgaaggtttagttcgttcccacttgttagttcaatccccaactggtttggtcaccatctccggtggtaaatggaccacctacagagaaatggcccaagaaactgttgactacctcgttgatcactttagctacggcgacaagaagctcttgccatgccagaccaacaaattgctcttggttggtggtgaaaactacaccaagaactactctgccagattgatccacgaatacaagatcccattgaagttggccaagcacttgtcccacaactacggttccagagctccattggtcttggacttgtacgctgaaagtgatttcaacaagttgccagtcaccttggctgccaccaaggagtttgagccatctgaaaagaaggccaacgaagacaaccagttgagttaccagagtttcgacgagccattcaccgttgctgagttgaagtactccttgaagtacgagtacccaagaaccccactcgatttcttggccagaagaacgagattggctttcttgaacgccagagaagccctcaatgcggttgatggggttgttgaaatcatgagtcaagagtacggctgggacaaggagaccgaagatagattgagaaaagaagccagacaatacattggtaatatgggtatttctccaaagaaatttgacgttgaaaagattgttattcaa

SEQ ID NO: 111 - protein, 335 aa, Archaeoglobus fulgidus
MIVSILGAGAMGSALSVPLVDNGNEVRIWGTEFDTEILKSISAGREHPRLGVKLNGVEIFWPEQLEKCLENAEVVLLGVSTDGVLPVMSRILPYLKDQYIVLISKGLIDFDNSVLTVPEAVWRLKHDLRERTVAITGPAIAREVAKRMPTTVVFSSPSESSANKMKEIFETEYFGVEVTTDIIGTEITSALKNVYSIAIAWIRGYESRKNVEMSNAKGVIATRAINEMAELIEILGGDRETAFGLSGFGDLIATFRGGRNGMLGELLGKGLSIDEAMEELERRGVGVVEGYKTAEKAYRLSSKINADTKLLDSIYRVLYEGLKVEEVLFELATFK

SEQ ID NO: 112 - DNA, 1008 bp, Archaeoglobus fulgidus
atgattgtttcgatactgggagcgggtgcaatgggctcagccctctccgtcccgctcgtagataacggcaacgaagtgagaatctgggggaccgagttcgatacggagattttaaaatcaatctcagccggcagagagcatccaaggcttggtgtaaagctcaatggcgtggaaattttctggccagagcagcttgaaaaatgtttggagaatgcagaggttgtacttctgggtgttagcacggatggcgtgctgcccgtaatgagcagaattctcccgtatctcaaggaccagtacatcgtactcatctctaaagggctgattgattttgataacagtgttctgacggttcccgaagctgtatggaggttaaagcacgatttgagggaaaggactgtggcgataaccgggcccgctattgcaagagaggtggcgaaacgcatgcccacaaccgttgttttcagcagcccatccgaaagctcggccaataaaatgaaagaaatctttgagacagagtactttggcgttgaagtaacaacagacataattggcacggaaataacctccgccctcaaaaacgtttattccatagccattgcatggataaggggctacgagagcagaaaaaacgttgagatgagcaatgcaaagggagtgattgcaacgagagccataaacgagatggcagagctgatagagattctcggaggggatagagagaccgcctttggcctttccggatttggagacctcatcgcaaccttcaggggaggaaggaacgggatgctgggagagctgcttggaaaggggcttagcatcgatgaggcgatggaggagcttgagaggagaggagttggtgtggttgagggctacaaaacggcagagaaagcatacaggctgtccagcaaaataaatgcagacacaaagctgctcgacagcatctacagagtcctttatgaaggactgaaggttgaggaagtgctgtttgaactcgctacatttaaataa

SEQ ID NO: 113 - protein, 418 aa, Candida sp.
MHALFSKSVFLKYVSSPTTSAIPHSLEFIVSRSSYLRRRIPPYLPRCSHFPSFYYSSSSVYTKKSFHTMSANIPKTQKAVVFEKNGGELKYKDIPVPTPKANELLINVKYSGVCHTDLHAWKGDWPLDTKLPLVGGHEGAGVVVGMGENVKGWKIGDFAGIKWLNGSCMSCEFCQQGAEPNCGEADLSGYTHDGSFEQYATADAVQAARIPAGTDLAEVAPILCAGVTVYKALKTADLAAGQWVAISGAGGGLGSLAVQYAVAMGLRVVAIDGGDEKGDFVKSLGAEAYIDFLKEKGIVAAVKKATDGGPHGAINVSVSEKAIDQSVEYVRPLGKVVLVGLPAGSKVTAGVFEAVVKSIEIKGSYVGNRKDTAEAVDFFSRGLIKCPIKIVGLSELPQVFKLMEEGKILGRYVLDTSK

SEQ ID NO: 114 - DNA, 1050 bp, Candida sp.
atgtctgctaatatcccaaaaactcaaaaagctgtcgtcttcgagaagaacggtggtgaattaaaatacaaagacatcccagtgccaaccccaaaggccaacgaattgctcatcaacgtcaagtactcgggtgtctgtcacactgatttgcacgcctggaagggtgactggccattggacaccaaattgccattggttggtggtcacgaaggtgctggtgttgttgtcggcatgggtgaaaacgtcaagggctggaaaatcggtgatttcgccggtatcaaatggttgaacggttcttgtatgtcctgtgagttctgtcagcaaggtgctgaaccaaactgtggtgaagctgacttgtctggttacacccacgatggttctttcgaacaatacgccactgctgatgctgtgcaagccgccagaatcccagctggcactgatttggccgaagttgccccaatcttgtgtgctggtgtcaccgtctacaaagccttgaagactgccgacttggctgctggtcaatgggtcgctatctccggtgctggtggtggtttgggctccttggctgtccaatacgccgtcgccatgggtttgagagtcgttgccattgacggtggtgacgaaaagggtgactttgtcaagtccttgggtgctgaagcctacattgatttcctcaaggaaaagggcattgttgctgctgtcaagaaggccactgatggcggtccacacggtgctatcaatgtttccgtttccgaaaaagccattgaccaatctgtcgagtacgttagaccattgggtaaggttgttttggttggtttgccagctggctccaaggtcactgctggtgttttcgaagccgttgtcaagtccattgaaatcaagggttcttacgtcggtaacagaaaggatactgccgaagccgttgactttttctccagaggcttgatcaagtgtccaatcaagattgtgggcttgagtgaattgccacaggtcttcaagttgatggaagaaggtaagatcttgggtagatacgtcttggatacctccaaa

SEQ ID NO: 115 - protein, 348 aa, Candida sp.
MSIPTTQKAIIFETNGGKLEYKDIPVPKPKPNELLINVKYSGVCHTDLHAWKGDWPLDTKLPLVGGHEGAGVVVAIGDNVKGWKVGDLAGVKWLNGSCMNCEYCQQGAEPNCPQADLSGYTHDGSFQQYATADAVQAARIPAGTDLANVAPILCAGVTVYKALKTADLQPGQWVAISGAAGGLGSLAVQYAKAMGYRVVAIDGGADKGEFVKSLGAEVFVDFLKEKDIVGAVKKATDGGPHGAVNVSISEKAINQSVDYVRTLGKVVLVGLPAGSKVSAPVFDSVVKSIQIKGSYVGNRKDTAEAVDFFSRGLIKCPIKVVGLSELPEVYKLMEEGKILGRYVLDNSK

SEQ ID NO: 116 - DNA, 1044 bp, Candida sp.
atgtcaattccaactactcaaaaagctatcattttcgaaaccaacggtggaaaattagaatacaaggacatcccagttccaaagccaaagccaaacgaattgctcatcaacgtcaagtactccggtgtctgccacactgatttacacgcctggaagggtgactggccattggacaccaagttgccattggtgggtggtcacgaaggtgctggtgttgttgttgccattggtgacaatgtcaagggatggaaggtcggtgatttggccggtgtcaagtggttgaacggttcctgtatgaactgtgagtactgtcaacagggtgccgaaccaaactgtccacaggctgacttgtctggttacacccacgacggttctttccagcaatacgccactgcagatgccgtgcaagccgctagaattccagctggtactgatttagccaacgttgcccccatcttgtgtgctggtgtcactgtttacaaggccttgaagaccgccgacttgcagccaggtcaatgggtcgccatttccggtgccgctggtggtttgggttctttggccgttcaatacgccaaggccatgggctacagagttgtcgccatcgatggtggtgccgacaagggtgagttcgtcaagtctttgggcgctgaggtctttgttgatttcctcaaggaaaaggacattgttggtgctgtcaagaaggcaaccgatggtggcccacacggtgccgttaacgtttccatctccgaaaaggccatcaaccaatctgtcgactacgttagaaccttgggtaaggttgtcttggtcggtttgccagctggctccaaggtttctgctccagtctttgactccgtcgtcaagtccatccaaatcaagggttcctatgtcggtaacagaaaggacactgccgaagctgttgactttttctccagaggcttgatcaagtgtccaatcaaggttgtcggtttgagtgaattgccagaagtctacaagttgatggaagaaggtaagatcttgggtagatacgtcttggacaactctaag

SEQ ID NO: 117 - protein, 348 aa, Candida sp.
MSIPTTQKAVIYEANSAPLQYTDIPVPVPKPNELLVHVKYSGVCHSDIHVWKGDWFPASKLPVVGGHEGAGVVVAIGENVQGWKVGDLAGIKMLNGSCMNCEYCQQGAEPNCPHADVSGYSHDGTFQQYATADAVQAAKFPAGSDLASIAPISCAGVTVYKALKTAGLQPGQWVAISGAAGGLGSLAVQYAKAMGLRVVAIDGGDERGVFVKSLGAEVFVDFTKEANVSEAIIKATDGGAHGVINVSISEKAINQSVEYVRTLGTVVLVGLPAGAKLEAPIFNAVAKSIQIKGSYVGNRRDTAEAVDFFARGLVKCPIKVVGLSELPEIFKLLEEGKILGRYVVDTAK

SEQ ID NO: 118 - DNA, 1044 bp, Candida sp.
atgtcaattccaactacccaaaaagctgttatctacgaagccaactctgctccattgcaatacaccgatatcccagttccagtccctaagccaaacgaattgctcgtccacgtcaaatactccggtgtttgtcactcagatatacacgtctggaagggtgactggttcccagcatcgaaattgcccgttgttggtggtcacgaaggtgccggtgttgtcgttgccattggtgaaaacgtccaaggctggaaagtaggtgacttggcaggtataaagatgttgaatggttcctgtatgaactgtgaatactgtcaacaaggtgctgaaccaaactgtccccacgctgatgtctcgggttactcccacgacggtactttccaacagtacgctaccgccgatgctgttcaagctgctaaattcccagctggttctgatttagctagcatcgcacctatatcctgcgccggtgttactgtttacaaagcattgaaaactgcaggcttgcagccaggtcaatgggttgccatctctggtgcagctggtggtttgggttctttggctgtgcaatacgccaaggccatgggtttgagagtcgtggccattgacggtggtgacgaaagaggagtgtttgtcaaatcgttgggtgctgaagttttcgttgatttcaccaaagaggccaatgtctctgaggctatcatcaaggctaccgacggtggtgcccatggcgtcatcaacgtttccatttctgaaaaagccatcaaccagtctgttgaatatgttagaactttgggaactgttgtcttggttggtttgccagctggtgcaaagctcgaagctcctatcttcaatgccgttgccaaatccatccaaatcaaaggttcttacgtgggaaacagaagagacactgctgaggctgttgatttcttcgctagaggtttggtcaaatgtccaattaaggttgttgggttgagtgaattgccagagattttcaaattgttggaagagggtaagatcttgggtagatacgttgttgacactgccaag

SEQ ID NO: 119 - protein, 349 aa, Candida sp.
MSTQSGYGYVKGQKTIQKYTDIPIPTPGPNEVLLKVEAAGLCLSDPHTLIGGPIESKPPLPNATKFIMGHEIAGSISQVGANLANDPYYKKGGRFALTIAQACGICENCRDGYDAKCESTTQAYGLNEDGGFQQYLLIKNLRTMLPIPEGVSYEEAAVSTDSVLTPFHAIQKVAHLLHPTTKVLVQGCGGLGFNAIQILKSYNCYIVATDVKPELEKLALEYGANEYHTDLTKSKHEPMSFDLIFDLVGIQPTFDLSDRYIKARGKILMIGLGRSKLFIPNYKLGIREVEIIFNFGGTSAEQIECMKWVAKGLIKPNIHVADFASLPEYLEDLAKGKLTGRIVFRPSKL

SEQ ID NO: 120 - DNA, 1047 bp, Candida sp.
atgtcaactcaatcaggttacggatacgtgaaaggacaaaagaccattcagaaatacaccgacatcccgatccctacgccgggccccaacgaagtcttgttgaaagtcgaagctgccggcttgtgtctctcggatccacacacgttgatcgggggtcccattgagagcaagccgccgttgccgaacgccacgaagttcatcatgggtcacgaaatcgcggggctgattagccaagtaggcgccaacttggccaacgatccatactataaaaagggaggtaggttcgccttgactatcgcgcaggcttgtgggatttgtgagaattgtcgtgatgggtatgatgcaaagtgtgagtctacgacgcaggcttatgggttgaacgaggacggtggattccagcaatacttgttgattaagaacttgcgtacgatgttgcctatccctgagggtgtgagttacgaagaagccgctgtgtctactgactctgtgttgactccattccatgcgattcagaaggtcgctcatttgttgcacccaactactaaggtgttggttcagggttgtggtgggttaggcttcaacgctattcaaatattgaagagctacaattgttacattgttgccactgatgtcaaaccagagcttgaaaaattagctttggagtatggtgccaacgaataccacactgatctcaccaagtccaagcatgagccaatgtcgttcgatttgattttcgaccttgtgggaatccaacctacttttgatttgtccgacaggtacatcaaagcaaggggtaagattcttatgattggcttaggcagatccaagttgtttattccaaattataaattgggtatccgtgaagtcgagatcattttcaattttggtggtacttcggccgagcaaattgagtgcatgaaatgggttgcaaaaggcttgatcaaacctaatattcacgtggctgattttgcttccttgcctgagtacctcgaggacttggccaagggtaaactcactggtagaattgtatttagaccaagtaagttg

SEQ ID NO: 121 - protein, 249 aa, Candida sp.
MSLSGKTSLIAAGTKNLGGASAKELAKAGSNLFLHYRSNPDEAEKFKQEILKEFPNVKVETYQSKLDRAADLTNLFAAAKKAFPSGIDVAVNFVGKVIKGPITEVTEEQFDEMDVANNKIAFFFIKEAAINLNKNGSIISIVTSLLPAYTDSYGLYQGTKGAVEYYSKSISKELIPKGITSNCIGPGPASTSFLFNSETKESVEFFKTVAIDQRLTEDSDIAPIVLFLATGGRWATGQTIYASGGFTAR

SEQ ID NO: 122 - DNA, 747 bp, Candida sp.
atgtcattatcaggaaagacctcattaattgctgctggtaccaagaacttgggtggtgcaagtgccaaagaattggccaaagccggctccaacctcttcttgcactacagatccaacccagacgaggctgaaaagttcaagcaagagatcctcaaggagttccctaacgtcaaggtcgaaacctaccaatccaaattggaccgtgccgccgacctcaccaacttgtttgctgctgccaagaaggcattccctagtggtattgacgtcgctgtcaactttgtcggtaaggtcatcaagggcccaatcactgaggtcactgaagaacagtttgacgagatggatgttgccaacaacaagattgcctttttcttcatcaaggaggccgctatcaacttgaacaagaacggtagtatcatttccatcgttactagtttgctcccagcttacaccgattcttacggtttgtaccagggtactaaaggagctgttgaatactattcgaaatctatcctgaaggagttgattccaaagggtatcaccagtaactgtattggtcctggtcctgcttctacttcctttttgtttaattccgaaaccaaggagagtgttgagttcttcaagaccgttgctattgaccaacgtttgactgaagacagcgacattgccccaattgtgttgttcctcgccactggaggtcgttgggcaactggtcaaactatttacgctagtggtggtttcactgctcgt

SEQ ID NO: 123 - protein, 366 aa, Candida sp.
MSLVLKRLLPIRSPTLLNSKFIQLQSQIRTMAIPATQTGFFFTKQEGLNYRTDIPVRKPQAGQLLLKVNAVGLCHSDLHVIDKELECGDNYVMGHEIAGTVAEVGPEVEGYKVGDRVACVGPNGCGVCKHCLTGNDNVCKTAFLDWFGLGSDGGYEEYLLVRRPRNLVKVPDNVSIEEAAAITDAVLTPYHAVKTAKVKPTSNVLVIGAGGLGGNGIQIVKAFGGKVTVVDKKDKARDQAKALGADEVYSEIPASIEPGTFDVCLDFVSVQATYDLCQKYCEPKGIIIPVGLGATKLTIDLADLDLREITVTGTFWGTANDLREAFDLVSQGKIKPIVSHAPLKELPNYMEKLKQGAYEGRVVFHP

SEQ ID NO: 124 - DNA, 1098 bp, Candida sp.
atgtcacttgtcctcaagcgattacttccaatcagatctcctactttactcaattcgaagttcatacagttacaatctcaaattcgcacaatggctatccccgctactcaaactggattcttcttcaccaaacaagaaggtttaaactacagaaccgacattcctgtccgcaagccacaagccggtcagttgttgttgaaggtcaatgccgttggtctctgccactcggacttgcacgtgattgacaaggagcttgaatgtggtgacaactatgtcatgggccacgaaattgccggtaccgttgctgaagttggtcccgaagttgaaggctacaaggttggcgaccgtgtcgcttgtgttggtcctaacgggtgcggtgtctgtaagcactgcttgactggtaacgacaatgtctgtaagactgctttcctcgactggttcgggttgggctccgatggtgggtacgaagagtacttgttggtgagaagaccaagaaacttggttaaggtcccggacaacgtctcgattgaggaggctgctgctatcactgatgctgtgttgactccttaccatgctgtcaagactgccaaggtcaagccaaccagtaacgttttggttattggtgctggtggattaggtggtaacggtatccagattgtcaaggcttttggcggtaaggttactgttgtcgataagaaggataaggcacgtgaccaagctaaggctttgggtgctgatgaagtctacagtgaaatcccagcaagtattgaaccgggtacttttgatgtctgtcttgattttgtttccgtgcaagccacctatgatctctgccaaaagtactgtgagccaaagggtatcattatcccagttgggttgggtgctaccaagctcaccattgatttggcagatttggatctccgtgaaatcacggttactggtaccttctggggaactgccaatgacttgagagaggcgtttgatttggttagtcaaggtaagatcaagccgattgtttcacatgccccattgaaggagttgccaaactatatggagaagttgaagcagggagcatatgaaggaagagttgtcttccaccca

SEQ ID NO: 125 - protein, 375 aa, Candida sp.
MTVDASSVPDKFQGFASDKRENWEHPKLISYDRKQLNDHDVVLKNETCGLCYSDIHTLRSTWGPYGTNELVVGHEICGTVIAVGPKVTEFKVGDRAGIGAASSSCRHCSRCTHDNEQYCKEQVSTYNSVDPKAAGYVTKGGYSSHSIADELFVFKVPDDLPFEYASPLFCAGITTFSPLYRNLVGSDKDATGKTVGIIGVGGLGHLAIQFASKALNAKVVAFSRSSSKKEEALELGAAEFVATNEDKNWTSRYEDQFDLILNCASGIDGLNLSDYLSVLKVDKKFVSVGLPPIDDEFNVSPFTFLKQGASFGSSLLGSKAEVNIMLELAAKHNIRPWIEKVPISEENVAKALKRCFEGDVRYRFVFTEFDKAFGN

SEQ ID NO: 126 - DNA, 1125 bp, Candida sp.
atgactgttgacgcttcttctgttccagacaagttccaagggtttgcctccgacaagagagaaaactgggaacacccaaagttgatctcctacgacagaaagcaactcaatgaccacgacgttgtcttgaagaacgagacctgtggtttgtgttactcggacatccacaccttgcgttccacgtggggaccatacggcaccaatgagcttgtcgttggccacgaaatctgtggtaccgtcattgctgtcggtccaaaggtcactgagttcaaggtcggtgacagagccggtattggtgctgcctcttcgtcttgtcgtcactgttccagatgtacccacgataacgagcaatactgtaaggaacaagtctccacttacaattctgttgatccaaaggccgctggttacgtcaccaagggtggttactcctcccactccatcgctgacgaattgtttgtcttcaaggttccagatgacttgccattcgagtacgcttccccattattctgtgctggtatcacaactttctccccattgtaccgtaacttggttgggtccgataaagacgccactggtaagaccgttggtatcattggtgttggtggtcttggtcaccttgccatccagtttgcgtctaaagctttgaacgctaaggtcgttgctttctccagatcctcctccaagaaggaagaagctctcgaattgggtgctgctgagtttgtcgccaccaacgaagacaagaactggaccagcagatacgaggaccaattcgacctcatcttgaactgtgcgagcggtatcgatggcttgaacttgtctgactacttgagtgtcttgaaagtcgacaagaagtttgtctctgttggtttgccaccaatcgacgacgagttcaacgtctctcctttcactttcttgaagcaaggtgccagtttcggtagttccttgttgggatccaaggctgaagtcaacatcatgttggaattggctgccaagcacaacatcagaccatggattgaaaaggtcccaatcagtgaggaaaacgtcgccaaggctttgaagagatgttttgaaggtgatgtcagatacagattcgtcttcactgagtttgacaaagcttttggcaat

SEQ ID NO: 127 - protein, 348 aa, Candida sp.
MSVPTTQKAVIFETNGGKLEYKDVPVPVPKPNELLVNVKYSGVCHSDLHVWKGDWPIPAKLPLVGGHEGAGVVVGMGDNVKGWKVGDLAGIKWLNGSCMNCEFCQQGAEPNCSRADMSGYTHDGTFQQYATADAVQAAKIPEGADMASIAPILCAGVTVYKALKNADLLAGQWVAISGAGGGLGSLGVQYAKAMGYRVLAIDGGDERGEFVKSLGAEVYIDFLKEQDIVSAIRKATGGGPHGVINVSVSEKAINQSVEYVRTLGKVVLVSLPAGGKLTAPLFESVARSIQIRTTCVGNRKDTTEAIDFFVRGLIDCPIKVAGLSEVPEIFDLMEQGKILGRYVVDTSK

SEQ ID NO: 128 - DNA, 1044 bp, Candida sp.
atgtccgttccaactactcagaaagctgttatctttgaaaccaatggtggcaagttagaatacaaagacgtgccggtccctgtccctaaacccaacgaattgcttgtcaacgtcaagtactcgggtgtgtgtcattctgacttgcatgtctggaaaggcgactggcccattcctgccaagttgcccttggtgggaggtcacgaaggtgctggtgtcgttgtcggcatgggtgacaacgtcaagggctggaaggtgggggacttggctggtatcaagtggttgaatggttcgtgtatgaactgtgagttttgccaacagggcgcagaacctaactgttcaagagccgacatgtctgggtatacccacgatggaactttccaacaatacgccactgctgatgctgtccaagctgccaagatcccagaaggcgccgacatggctagtatcgccccgatcttgtgcgctggtgtgaccgtgtacaaggctttgaagaacgccgacttgttggctggccaatgggtggctatctctggtgctggtggtggtttgggctccttgggtgtgcagtacgctaaagccatgggttacagagtgttggctatcgacggtggtgacgagagaggagagtttgtcaagtccttgggcgccgaagtgtacattgacttccttaaggaacaggacatcgttagtgctatcagaaaggcaactggtggtggtccacacggtgttattaacgtctcagtgtccgaaaaggcaatcaaccagtcggtggagtacgtcagaactttggggaaagtggttttagttagcttgccggcaggtggtaaactcactgctcctcttttcgagtctgttgctagatcaatccagattagaactacgtgtgttggcaacagaaaggatactactgaagctattgatttctttgttagagggttgatcgattgcccaattaaagtcgctggtttaagtgaagtgccagagatttttgacttgatggagcagggaaagatcttgggtagatatgtcgttgatacgtcaaag

SEQ ID NO: 129 - protein, 381 aa, Candida sp.
MSESTVGKPITCKAAVAWEAGKPLTIEDVTVAPPKAHEVRIKILYTGVCHTDAYTLSGVDPEGAFPVILGHEGAGIVESVGEGVTTVKPGDHVIALYTPECGECKFCKSGKTNLCGKIRATQGKGVMPDGTPRFTCKGKELIHFMGCSTFSQYTVVTDISVVAINDKAELDKACLLGCGITTGYGAATITANVQKGDNVAVFGGGAVGLSVLQGCKEREAAQIILVDVNNKKKEWGEKFGATAFINPLELPKGVTIVDKLIEMTDGGCDFTFDCTGNVNVMRDALEACHKGWGTSVIIGVAAAGKEISTRPFQLVTGRVWKGAAFGGVKGRSQLPGIVEDYMVGKLKVEEFITHRKPLEQINEAFEDMHAGDCIRAVVNMW

SEQ ID NO: 130 - DNA, 1143 bp, Candida sp.
atgtctgaatcaaccgttggaaaaccaatcacctgtaaagccgctgttgcctgggaagcaggcaagcctttgaccatcgaagacgtcactgttgctccaccaaaggcccacgaagtgcgtatcaagatcttgtacactggtgtctgtcacactgatgcctacaccttgagtggtgttgatccagagggtgccttcccagtcatcttgggacacgaaggtgccggtattgttgaaagtgttggtgaaggtgtcaccactgtcaagccaggcgaccacgtcattgcattatacactccagaatgtggtgagtgtaagttctgtaaatcgggtaagaccaacttgtgtggtaaaatcagagctacccaaggcaaaggtgtgatgccagacggaactccaagattcacttgcaagggcaaagaattgattcactttatgggatgctccaccttctcccaatacaccgttgtcactgacatttccgtcgtggccatcaacgacaaagccgaacttgacaaggcttgtttgttgggatgtggtatcactactggttatggtgctgccaccatcactgccaatgttcaaaagggtgacaatgtcgcagttttcggtggtggtgctgtcggattgtccgtcctccaaggatgtaaagaaagagaagctgcccaaatcattttggttgatgtcaacaacaagaagaaggaatggggtgaaaagttcggtgccactgcttttatcaacccattagaattaccaaaaggcgtcactattgttgacaagttgattgaaatgactgacggtggttgtgactttacttttgactgtaccggtaatgtcaatgttatgagagatgccttggaagcttgtcataagggttggggtacttcagtcatcatcggtgttgccgctgccggtaaggaaatctccaccagaccattccaattggtcactggtagagtctggaagggtgctgctttcggtggcgtcaagggtagatcccaattgccaggaatcgttgaagactacatggttggtaagttgaaggttgaagagtttatcacccacagaaaaccattggaacaaatcaatgaagcatttgaagacatgcatgctggtgattgtattagagctgttgtcaacatgtgg

SEQ ID NO: 131 - DNA, 2115 bp, Candida sp.; identical to SEQ ID NO: 2

SEQ ID NO: 132 - protein, 704 aa, Candida sp.; identical to SEQ ID NO: 3

SEQ ID NO: 133 - DNA, 2106 bp, Candida sp.
atggctccatttttgcccgaccaggtcgactacaaacacgtcgacacccttatgttattatgtgacgggatcatccacgaaaccaccgtcgaccaaatcaaagacgttattgctcctgacttccctgctgacaagtacgaagagtacgtcaggacattcaccaaaccctccgaaaccccagggttcagggaaaccgtctacaacacagtcaacgcaaacaccacggacgcaatccaccagttcattatcttgaccaatgttttggcatccagggtcttggctccagctttgaccaactcgttgacgcctatcaaggacatgagcttggaagaccgtgaaaaattgttggcctcgtggcgcgactccccaatcgctgccaaaaggaagttgttcaggttggtttctacgcttaccttggtcacgttcacgagattggccaatgagttgcatttgaaagccattcattatccaggaagagaagaccgtgaaaaggcttatgaaacccaggagattgacccttttaagtaccagtttttggaaaaaccgaagttttacggcgctgagttgtacttgccagatattgatgtgatcattattggatctggtgccggtgctggtgttgtggcccacactttggccaacgatggcttcaagagtttggttttggaaaagggcaaatactttagcaactccgagttgaactttgatgacaaggacggcgttcaagaattataccaaagtggaggtactttgactacagtcaaccaacagttgtttgttcttgctggttccacttttggtggcggtaccactgtcaattggtcagcctgtcttaagacgccattcaaggtgcgtaaggaatggtatgatgagtttggtgttgactttgctgctgatgaagcatacgataaagcgcaggattatgtttggcagcaaatgggagcttctaccgaaggcatcacccactctttggctaacgagattattattgaaggtggtaagaaattaggttacaaggccaaggtattagaccaaaacagcggtggtcatcctcagcacagatgcggtttctgttatttgggctgtaagcacggtatcaagcagggttctgttaataactggtttagagacgcagctgcccacggttcccagttcatgcaacaggttagagttttgcaaatacttaacaagaaggggatcgcttacggtatcttgtgtgaggatgttgtaaccggcgccaagttcaccattactggccccaaaaagtttgttgttgctgccggtgctttgaacactccatctgtgttggtcaactccggcttcaagaacaagaacatcggtaagaacttaactttgcacccagtttctgtcgtgtttggtgattttggcaaagacgttcaagcagaccacttccacaactccatcatgactgccctttgttcagaagccgctgatttagacggcaagggccatggatgcagaattgaaaccatcttgaacgctccattcatccaggcttcattcttaccatggagaggtagtaacgaggctagacgagacttgttgcgttacaacaacatggtggcgatgttgctccttagtcgtgacaccaccagtggttccgtttctgctcatccaaccaaacctgaagctttggttgtcgagtacgacgtgaacaagtttgacagaaactcgatcttgcaggcattgttggtcactgctgacttgttgtatatccaaggtgccaagagaatccttagtccacaggcatgggtgccaatttttgaatccgacaagccaaaggataagagatcaatcaaggacgaggactatgtcgaatggagagccaaggttgccaagattcctttcgacacctacggctcaccttatggttcggcacatcaaatgtcttcttgccgtatgtcaggtaagggtcctaaatacggtgctgttgacaccgatggtagattgtttgaatgttcgaatgtttatgttgccgatgcaagtcttttgccaactgcaagcggtgccaaccctatggtcaccaccatgactcttgccagacatgttgcgttaggtttggcagactccttgaagaccaaatag

SEQ ID NO: 134 - protein, 701 aa, Candida sp.
MAPFLPDQVDYKHVDTLMLLCDGIIHETTVDQIKDVIAPDFPADKYEEYVRTFTKPSETPGFRETVYNTVNANTTDAIHQFIILTNVLASRVLAPALTNSLTPIKDMSLEDREKLLASWRDSPIAAKRKLFRLVSTLTLVTFTRLANELHLKAIHYPGREDREKAYETQEIDPFKYQFLEKPKFYGAELYLPDIDVIIIGSGAGAGVVAHTLANDGFKSLVLEKGKYFSNSELNFDDKDGVQELYQSGGTLTTVNQQLFVLAGSTFGGGTTVNWSACLKTPFKVRKEWYDEFGVDFAADEAYDKAQDYVWQQMGASTEGITHSLANEIIIEGGKKLGYKAKVLDQNSGGHPQHRCGFCYLGCKHGIKQGSVNNWFRDAAAHGSQFMQQVRVLQILNKKGIAYGILCEDVVTGAKFTITGPKKFVVAAGALNTPSVLVNSGFKNKNIGKNLTLHPVSVVFGDFGKDVQADHFHNSIMTALCSEAADLDGKGHGCRIETILNAPFIQASFLPWRGSNEARRDLLRYNNMVAMLLLSRDTTSGSVSAHPTKPEALVVEYDVNKFDRNSILQALLVTADLLYIQGAKRILSPQAWVPIFESDKPKDKRSIKDEDYVEWRAKVAKIPFDTYGSPYGSAHQMSSCRMSGKGPKYGAVDTDGRLFECSNVYVADASLLPTASGANPMVTTMTLARHVALGLADSLKTK

SEQ ID NO: 135 - protein, 549 aa, Candida sp.
MLSRVLFKTKPRVPTKSITAMAIRNKSIVTLSSTTSTYPTDHTTPSTEPYITPSFVNNEFIKSDSNTWFDVHDPATNYVVSKVPQSTPEELEEAIASAHAAFPKWRDTSIIKRQGIAFKFVQLLRENMDRIASVIVLEQGKTFVDAQGDVTRGLQVAEAACNITNDLKGESLEVSTDMETKMIREPLGVVGSICPFNFPAMVPLWSLPLVLVTGNTAVIKPSERVPGASMIICELAAKAGVPPGVLNIVHGKHDTVNKLIEDPRIKALTFVGGDKAGKYIYEKGSSLGKRVQANLGAKNHLVVLPDAHKQSFVNAVNGAAFGAAGQRCMAISVLVTVGKTKEWVQDVIKDAKLLNTGSGFDPKSDLGPVINPESLTRAEEIIADSVANGAVLELDGRGYRPEDARFAKGNFLGPTILTNVKPGLRAYDEEIFAPVLSVVNVDTIDEAIELINNNKYGNGVSLFTSSGGSAQYFTKRIDVGQVGINVPIPVPLPMFSFTGSRGSFLGDLNFYGKAGITFLTKPKTITSAWKTNLIDDEILKPSTSMPVQQ

SEQ ID NO: 136 - DNA, 1647 bp, Candida sp.
atgttatccagagttcttttcaagactaaaccaagagttcctactaaatcaatcaccgccatggccatcagaaacaaatccatcgtgactttatcctccaccacctccacatacccaaccgaccacacgaccccgtccacggagccatacatcacgccatccttcgtgaacaacgagttcatcaagtcggactccaacacctggttcgacgtgcacgacccggccacgaactacgtcgtgtccaaggtgccacagtcgacgccggaggagttggaagaagcaatcgcgtcggcccacgccgcgttccccaaatggcgcgacaccagcatcatcaagcgtcaagggatcgcgttcaagtttgtgcagttgttgcgcgagaacatggacagaatcgcaagcgtcattgtcttggaacaaggtaagacgtttgtcgatgcccagggtgacgtgactagaggattacaggttgctgaggctgcgtgcaacatcactaacgacttgaaaggtgagtcgttggaagtgtctactgatatggagaccaagatgattagagaacctttgggtgttgtgggatccatctgtccttttaacttcccagctatggtcccattgtggtctttgcctttggttttggtcacgggtaacaccgctgtgattaagccttccgagagagtcccgggcgcaagtatgattatttgtgaattggccgccaaggcaggtgttccacctggtgtgttgaacattgtccacggtaagcacgacaccgtcaacaagttgatcgaggacccaagaatcaaggcattgacttttgtcggtggtgacaaggccggtaagtacatttacgaaaagggttccagtttgggcaagagagtgcaggccaacttgggtgctaagaaccacttggttgtgttgccagacgcacacaagcagagttttgtcaatgccgtcaacggtgccgctttcggtgctgctggacagagatgtatggctatttctgtcttggtcaccgtgggtaagaccaaggaatgggtgcaggatgtcatcaaggacgccaagttgttgaacaccggaagtggatttgacccaaagagtgacttgggtccagtcatcaacccagagtccttgactcgtgctgaagaaatcattgctgattccgtggccaacggtgccgtgttggaattggacggaagaggatacagaccagaagacgccagattcgccaagggtaacttcttgggtccaaccatcttgaccaacgtcaagccgggcttgagagcatacgacgaggagattttcgctcctgttttgtcggtggttaacgtcgacaccattgacgaagccattgagttgatcaacaataacaagtacggtaacggtgtttcattatttacttcctccggtggctcagcccagtatttcactaagagaatcgatgtcggccaagtcggtatcaatgtcccaatccctgttccattgcctatgttctccttcactggttccagaggctccttcttgggtgacttgaacttctacggtaaggccggtatcaccttcttgaccaagccaaagaccatcactagtgcctggaagaccaacttgattgatgacgagatcttgaaaccatctacctcgatgcctgtccaacag

SEQ ID NO: 137 - protein, 493 aa, Candida sp.
MSLPVVTKLTTPKGLSYNQPLGLFINNEFVVPKSKQTFEVFSPSTEEKITDVYEALAEDVDVAAEAAYAAYHNDWALGAPEQRAKILLKLADLVEEHAETLAQIETWDNGKSLQNARGDIGFTAAYFRSCGGWADKNTGDNINTGGTHLTYTQRVPLVCGQIIPWNASTLMASWKLGPVIATGGTTVLKSAEATPLAVLYLAQLLVEAGLPKGVVNIVSGFGTTAGSAIASHPKIDKVAFTGSTNTGKIIMKLAAESNLKKVTLELGGKSPHIVFNDADLDRAVSYLVAAIFSNSGETCAAGSRVLVQSGVYDEVVAKFKKGAEAVKVGDPFDEETFMGSQVNEVQLSRILQYIESGKEQGATVVTGGGRAGDKGYFVKPTIFADVHKDMTIVKEEIFGPVVSVVKFDTIEEAIALANDSEYGLAAGIHTTNISTGVTVANRIKSGTVWVNTYNDLHPMVPFGGFGASGIGREMGAEVMKEYTEVKAVRIKLT

SEQ ID NO: 138 - DNA, 1479 bp, Candida sp.
atgtctttgccagtcgtcaccaaactcactactcctaagggtctctcctacaaccaaccattaggtttgttcatcaacaacgagttcgttgttccaaaatccaagcaaaccttcgaagtcttctccccttccaccgaagagaagatcaccgatgtctacgaagctttagccgaagatgtcgacgttgctgccgaagcagcttacgccgcctaccacaacgactgggcccttggtgctccagaacaaagagccaagatcttgctcaagttggccgacttggtcgaagaacacgccgagaccttggcccagatcgaaacctgggacaacggtaagtccttgcagaacgccagaggcgatatcggattcactgccgcttactttagatcctgtggtggatgggccgacaagaacaccggtgacaacatcaacaccggtggcacccaccttacttacacccagagagtcccattggtgtgtggtcaaatcatcccttggaacgcaagtaccttgatggccagttggaagcttggtcccgttatcgctaccggtggtaccactgtgcttaaatcagctgaagctaccccattagctgtcttgtacctcgcccaattgttagttgaagccggtcttccaaagggtgtcgttaacattgtttccggtttcggtaccactgccggttccgctatcgctagccatccaaagatcgacaaggtcgcctttactggttccaccaacaccggtaagatcatcatgaagttggctgcggagtccaacttgaagaaggtcactttggaattgggtggtaagtccccacacattgttttcaacgacgctgacttggaccgcgccgtcagctacttggttgctgccattttcagtaactccggcgagacctgtgctgccggatcccgtgtcttggtgcaatccggtgtctacgacgaagttgttgctaagttcaagaagggcgccgaggccgttaaagttggtgacccattcgacgaagaaaccttcatgggttcccaagtcaacgaagtccaattgtctagaatcttgcaatacatcgagctgggtaaggaacaaggtgccactgttgtcaccggtggtggtagagccggggacaagggttacttcgtcaagccaactattttcgccgacgttcacaaggacatgactatcgtcaaggaagaaatctttggtcctgttgtctccgtcgtcaaattcgataccattgaagaagctatcgctttggctaacgactccgaatacggtttggccgctggtatccacaccactaacatcagcaccggtgtcaccgtcgctaacagaatcaagtccggtactgtctgggtcaacacttacaatgacttgcaccccatggttccattcggtggtttcggcgcttctggtatcggcagagaaatgggtgcagaagtcatgaaggaatacaccgaagttaaggctgttagaattaagctcact

SEQ ID NO: 139 - protein, 678 aa, Candida sp.
MSKSYKLPKSSKISPIVKGKTSAKSKSSSKTPSPPSGSPPTSARIAAPELEPVEQTSDNELPATKVAVRRSSSASSKSTNGSAAATSAAAANAAAPQKTPVEAKPAPKPEPVQSKGNDNDSDDSKLDTAESYVDVKKETEALVESKSVASTVDDTSVLQYTPLSEIPGGVKRVVDGFHTGKTHPLEFRLKQLRNLYFAVRDNQEAICDALSKDFHRVSSETRNYELVTGLNELLYTMSQLHKWSKPLPVDELPLNLMINPTYVERIPVGTVLVIAAFNYPLFVSISPIAGAIAAGNTVVFKPSELTPHFSKLFTDLMAKALDPDVFYAVNGSVPETTELLNQKFDKIIYTGSETVGKIIAKKAAETLTPVILELGGKSPAFVLDDVADKDLPIVARRIAWGRYANAGQTCIGVDYVLVAKSKHDKFIKALRDVIEKEFFPNVDANSNFTHLIHDRAFHKMKNIIDKTTGKIIIGGQMDSASRYVSPTVIDDATWDDSSMQEEIFGPILPVLTYTDLTDACRDVVSHHDTPLAEYIFTSGSTSRKYNSQINTIATIIRSGGLVINDVLMHIALHNAPFGGIGKSGHGAYHGEFSYRAFTHERTVLEQNLWNDWIIKSRYPPYSNKKDRLVASSQGKYGGRVWFGRQGDVKIDGPSTFFSAWTNVLGVAGVVCDFIGASL

SEQ ID NO: 140 - DNA, 2034 bp, Candida sp.
atgagtaagtcatacaagttgccaaaatcatctaagatctcgcctatcgtaaagggtaagacctcggcaaaatcaaaaagtagctcaaaaacaccatcaccaccactgggatccccaccaacatcagccaggatcgctgcgcctgaattggaaccggtcgaacaaacatccgacaacgagctcccagctactaaagtggccgttcgcagaagcagcagcgcttcatcgaagtcaaccaacgggtccgcggctgccacttctgccgctgctgccaatgctgctgccccacaaaaaactccagttgaagcaaagccagcccctaagccagagccagttcagtccaagggtaacgacaacgactccgatgactccaagttagacaccgctgaatcatatgtcgacgtgaagaaagaaaccgaagctctcgttgagtcaaagtcggttgcttcaacagtcgatgatacttctgtcttgcagtacaccccgttatctgagatccctggcggcgtcaagagagttgtcgatgggttccacaccggcaagacccacccattggagtttagattgaagcaattgagaaacttgtacttcgccgtgagggataaccaagaagccatctgtgacgccttgagcaaggatttccaccgtgtctcatccgaaactagaaactatgaattggttaccgggttgaatgaattgttgtacacgatgtcgcaattgcacaagtggagcaagccattgccagtggatgagttgccattgaacttgatgatcaaccctacttatgttgaaagaatcccagttggtacggttttggtcatcgccgctttcaactatccattgtttgtttcgatttcccctattgccggtgccattgctgctggtaacactgttgtgttcaagccatctgaattgactccgcacttttccaagttgttcactgatttgatggctaaagcgttggacccagatgtcttttatgccgtgaacggttccgtgcctgaaactaccgagttgttgaaccagaagttcgacaagatcatttacaccggtagtgaaactgttggtaagatcattgccaagaaggcggccgagacgttgacgccagtgattttggaacttggaggcaaatcgccagcctttgttttggacgacgttgccgacaaagacttgccaattgttgcgcgtcgtattgcttggggaagatatgctaatgctggacagacctgtattggtgttgattatgtgttggttgcaaagtccaaacacgacaagttcatcaaggctttgagggatgttattgagaaagagttcttccccaatgttgacgctaacagcaactttacccatttgatccacgacagggcattccacaaaatgaagaacatcattgacaaaaccacagggaagataatcatcggtggtcaaatggatagtgcttccaggtatgtctcaccaactgtgattgacgatgctacctgggacgactcgtccatgcaggaggaaatatttggccctatcttgccggttctcacttatactgaccttactgatgcatgtcgtgacgttgtttctcaccatgatactccgttggctgaatacatcttcaccagcgggtccacttcaagaaagtacaactcgcagatcaacaccattgctactatcatcagatccggtgggttagtcataaatgatgtgttgatgcacattgccttgcacaacgctccgttcggtggtattggtaaatctggacatggtgcctaccacggagaattctcctacagggcttttacccacgagagaaccgttcttgaacaaaacttgtggaatgactggatcattaagtcaagatacccaccatattccaataagaaagacaggttggttgctagttcacaaggcaagtatggtggaagagtttggttcggacgtcaaggtgatgtcaagattgacggaccatccacgttcttctcggcatggaccaatgtccttggtgtagctggtgtagtgtgtgattttattggtgcctctttg

SEQ ID NO: 141 - protein, 545 aa, Candida sp.
MSPPSKLEDSSSATTAADTLGDSWYTKVSDIAPGVQRLTESFHRDQKTHDIQFRLNQLRNLYFAVQDNADALCAALDKDFYRPPSETKNLELVGGLNELVHTISSLHEWMKPEKVTDLPLTLRSNPIYIERIPLGVVLIISPFNYPFFLSFSAVVGAIAGGNAVVLKGSELTPNFSSLFSKILTKALDPDIFFAVDGAIPETTELLEQKFDKIMYTGNNTVGKIIAKKAAETLTPVILELGGKSPAFILDDVKDKNLEVIARRIAWGRFTNAGQTCVAVDYVLVPTKLHKKFIAALTKVLSQEFYPNLTKDTKGYTHVIHDRAFNNLSKIISTTKGDIVFGGDTDAATRFIAPTVIDNATWEDSSMKGEIFGPILPVLTYDKLTTAIRQVVSTHDTPLAQYIFTSGSTSRKYNRQLDQILTGVRSGGVIVNDVLMHVALINAPFGGVGDSGYGSYHGKFSFRSFTHERTTMEQKLWNDGMVKVRYPPYNSNKDKLIQVSQQNYNGKVWFDRNGDVPVNGPGALFSAWTTFTGVFHLLGEFITNKQ

SEQ ID NO: 142 - DNA, 1639 bp, Candida sp.
atgtccccaccatctaaattagaagactcctcctccgcaaccaccgctgccgatacccttggcgactcctggtacaccaaagtgtccgacattgcgcctggcgtgcagagattgaccgagtcattccacagggatcaaaagacgcacgacattcagttccgcttgaaccaattgcgtaacctttactttgcggtccaggacaatgccgacgcgctctgtgctgccttggacaaggacttctaccgtccccccagtgaaaccaagaacttggaactcgtgggtggcttgaatgagttggtgcacaccatttcgagcttgcatgagtggatgaagccggaaaaagtcacggatttgccacttactttgaggtcaaacccgatttatattgaaagaatcccattgggggtcgtgttgatcatctcgcctttcaactaccctttcttcttgtcgttttcggccgtcgtgggtgcgattgctggtggtaacgcggttgttttgaagggctctgagttgacgccaaacttctccagtttgttctcaaagatcttgactaaggctttggaccctgatattttctttgcagtcgatggtgctatccctgagacgaccgagttgttggaacaaaagtttgacaagatcatgtatactggtaacaacaccgtgggtaagattattgccaagaaggctgctgagaccttgacgccagttatcttggaattgggtggtaagtcgccagctttcatcttggacgacgtcaaggataaaaacttggaagtcatcgccagaagaatcgcatggggtagattcaccaacgccggtcaaacctgtgttgctgtcgactacgtcttggttccaaccaaactccacaagaagttcattgctgcgttgaccaaggtcttgagtcaagaattctaccctaacttgaccaaagacaccaagggctacacccacgtcatccacgaccgtgcattcaacaatttgtccaagatcatcagcaccaccaagggtgacattgtctttggcggcgacaccgatgccgccacccgcttcatcgcccccaccgtcatcgacaacgccacctgggaggattcttccatgaagggcgaaatctttggtcccatcttgcccgtcttgacctacgacaagctcaccaccgccatcaggcaagttgtgtccacgcacgacacgccattagcgcagtacatcttcaccagcgggtccacatcccgcaagtacaaccgccagctcgaccagatcttgactggtgtccggtccgggggtgtgattgtcaacgatgtcttgatgcacgttgcgttgatcaatgcgccatttggcggcgttggtgactccgggtacggctcgtaccacggcaagttctcgttccgcagcttcacgcacgaacgtaccaccatggagcagaagttgtggaacgacgggatggtcaaggtcagataccctccttataactccaacaaggacaagttgatccaggtctcccagcagaactacaacggcaaggtctggttcgatagaaacggcgacgtgcctgtgaatggaccaggtgcgttgtttagcgcttggactacgttcactggtgtcttccatttgcttggtgagttcatcactaataagcaataga

SEQ ID NO: 143 - protein, 661 aa, Candida sp.
  MOD_RES (193)..(195): Any amino acid
MVSSTATASATSGEMRTVKTPVGIKAAIESLKPKATRVSMDGPVECPLTDFALLNSPQFNKGSAFSLEERKSFKLTGLLPSQVNTLDEQVERAYRQFTYLKTPLAKNDFCTSMRLQNKVLYYELVRRNIREMLPIIYTPTEGDAIASYSDRFRKPEGCFLDINDPDNIDERLAAYGENKDIDYIVMSDGEGIXXXSDRFRKPEGCFLDINDPDNIDERLAAYGENKDIDYIVMSDGEGILGIGDQGVGGIRIAIAKLGLMTLCGGIHPARVLPITLDVGTNNDRLLNDDLYMGNKFPRVRGERYWDFVDKVIHAITKRFPSAVMHYEDFGVTTGRDMLHKYRTALPSFNDDIQGTGAVVMASITAALKFSNRSLKDIEVLIYGAGSAGLGIADQITNHLVSHGATPEQARSRIHCMDRYGLITTESNNASPAQMNYADKASDWEGVDTSSLLACVEKVKPTVLVGCSTQAGAFTEEVVKTMYKYNPQPIIFPLSNPTRLHEAVPADLMKWTDNNALIATGSPFEPVDGYYISENNNCFTFPGIGLGAVLSRCSTISDTMISAAVDRLASMSPKMENPKNGLLPRLEEIDEVSAHVATAVILQSLKEGTARVESEKKPDGGYVEVPRDYDDCLKWVQSQMWKPVYRPYIKVEYVSNIHTYQY

SEQ ID NO: 144 - DNA, 1983 bp, Candida sp.
  modified_base (577)..(584): a, c, t, g, unknown or other
atggtctcctccacggccaccgcatccgccacgtcaggggaaatgcgtaccgtcaagaccccagtggggatcaaggcggccatcgaatcattaaaaccaaaagctactagagtctccatggacggacctgtcgaatgcccattgaccgatttcgccttgttgaactcccctcaattcaacaaaggttcggcattttctttggaagaaaggaaaagtttcaagttgaccgggctcctcccttctcaagtcaacactttggatgaacaggttgaaagagcctatagacaattcacatacttgaagaccccattggccaagaacgatttctgcacgtctatgagattgcagaacaaagtgctttactacgagttggttagaagaaatatccgtgagatgttgcccatcatctacaccccaaccgaaggggacgccatcgccagttattccgacaggttcagaaaaccagagggctgtttcttggatatcaacgaccccgacaacatcgatgagagattagctgcctatggggagaacaaagacatagattacattgtcatgagtgacggagaaggtatcnnnnnnnnctccgacaggttcagaaaaccagagggctgcttcttggacatcaatgacccagacaacatcgacgagagattggctgcctatggggagaacaaagacatagattacattgtcatgagtgacggagaaggtatcctcggtattggagaccaaggcgtcggtggtatcagaattgccattgctaaattggggttgatgaccctttgtggtggtattcacccggccagagttttgcccatcactttggatgttggtacaaataacgacaggttgttgaatgatgatttgtacatgggcaacaagttccctagagtcagaggagaaagatactgggactttgtcgataaggtcatacacgcaattacgaaacggttcccaagtgccgtgatgcattacgaagatttcggagtcacaactggtagggacatgttgcacaagtaccgtacggctcttccttctttcaacgacgacatccaaggtaccggtgcagttgtcatggcatcgatcacagctgccttgaagttctccaaccgtagcctaaaggacatcgaggttttgatttacggtgccggctcagctggtttaggtattgctgaccagatcaccaaccacttggtcagccacggcgctactccagaacaagccagatctaggatccattgtatggaccgttatgggttgatcacaactgaatccaacaacgccagtcctgctcaaatgaactacgccgacaaggcatctgattgggaaggtgtcgatacctcgagtctacttgcctgtgttgagaaagtcaaaccaactgtcttggttgggtgttccactcaggcaggtgcattcaccgaagaggttgtcaaaaccatgtacaagtacaacccacagccaattattttcccattgtccaaccctaccagattgcatgaagccgtgccggctgatttgatgaaatggaccgacaacaacgcgttgattgccaccggttctccatttgaacctgtcgatggctactacatttccgaaaacaacaactgtttcaccttcccaggtattgggttgggtgctgtcttgtccagatgtagcaccatttcggataccatgatttctgccgccgttgatagattggcttcgatgtcgccaaagatggagaacccaaagaacggattgttgcctagattggaagaaatcgacgaagtcagtgcccatgttgccacggctgttatcttgcaatctttgaaggaaggcaccgctagagtcgaaagcgagaagaagccagacggtggttacgttgaagttccaagagactatgatgattgtcttaagtgggtgcaatcacaaatgtggaagccagtgtacagaccatacatcaaggttgagtacgtttcgaatattcacacctatcaatat

SEQ ID NO: 145 - protein, 506 aa, Saccharomyces cerevisiae
MPESRLQRLANLKIGTPQQLRRTSIIGTIGPKTNSCEAITALRKAGLNIIRLNFSHGSYEFHQSVIENAVKSEQQFPGRPLAIALDTKGPEIRTGRTLNDQDLYIPVDHQMIFTTDASFANTSNDKIMYIDYANLTKVIVPGRFIYVDDGILSFKVLQIIDESNLRVQAVNSGYIASHKGVNLPNTDVDLPPLSAKDMKDLQFGVRNGIHIVFASFIRTSEDVLSIRKALGSEGQDIKIISKIENQQGLDNFDEILEVTDGVMIARGDLGIEILAPEVLAIQKKLIAKCNLAGKPVICATQMLDSMTHNPRPTRAEVSDVGNAVLDGADCVMLSGETAKGDYPVNAVNIMAATALIAESTIAHLALYDDLRDATPKPTSTTETVAAAATAAILEQDGKAIVVLSTTGNTARLLSKYRPSCPIILVTRHARTARIAHLYRGVFPFLYEPKRLDDWGEDVHRRLKFGVEMARSFGMVDNGDTVVSIQGFKGGVGHSNTLRISTVGQEF

SEQ ID NO: 146 - DNA, 1521 bp, Saccharomyces cerevisiae
atgccagagtccagattgcagagactagctaatttgaaaataggaactccgcagcagctcagacgcacctccataataggtaccattgggcccaagacaaatagctgcgaggccattactgctctgagaaaagctggtttgaacatcattcgattgaacttttcccatggctcctacgaattccatcaatcagtaatcgaaaatgctgtgaaatcggaacagcaattccctggcaggccgctcgccattgccctggataccaagggtcccgagatcagaacaggtcgcacgttaaatgaccaagatctttatatccccgtagaccaccaaatgatctttaccactgacgcaagttttgcaaacacctccaatgataaaatcatgtatatagactatgctaacctgacaaaagttatcgttccggggagatttatatacgtggacgacgggattctctcttttaaagtgctccaaatcattgacgaatctaatttaagggtgcaagcggtaaactcgggttatatcgcatctcataaaggtgttaatctgcctaataccgacgttgatttgccccccttgtccgccaaagacatgaaggacttgcaattcggagtccgcaatggcattcacatcgtatttgcctctttcataagaacttcagaagatgtgttgtctatcagaaaagcgttgggttctgaagggcaagatatcaagattatatccaagatagaaaaccagcaagggttggataattttgacgaaatcctggaagtcacggatggtgttatgatagcgagaggcgatttaggaattgaaatcctggcacctgaagtattagccattcaaaaaaagctgattgcaaaatgtaatttggcgggcaaacctgtcatttgcgcgactcagatgctggattcaatgacacacaatccgagaccgacaagggctgaagtatcggatgtgggtaacgctgtgttggatggtgctgattgtgttatgctttctggagaaacggcgaagggtgattatccggtgaatgcagttaatattatggcggcgaccgctctgattgctgaaagtactatcgctcatttggctctttatgacgatctcagagacgccactcccaaacctacttccactacggaaactgtagcagctgcagctaccgcagcaatcttggagcaagatggtaaggccatcgttgtattatctactacagggaacacggcaaggctactgtcgaagtatagaccaagctgccctatcatattagtaacaagacacgcaagaacggcaagaattgcgcatttgtatagaggtgttttcccatttctgtatgaaccgaaacgcctagacgactggggtgaggatgttcataggcgcctaaagtttggtgttgaaatggcgaggtctttcggaatggtggacaacggtgatactgttgtttccattcaaggattcaaaggaggagtcggccattccaataccttacgcatttctactgttggtcaagaattctag

SEQ ID NO: 147 - DNA, 1953 bp, Candida sp.
atgtcaggattagaaatagccgctgctgccatccttggtagtcagttattggaagccaaatatttaattgccgacgacgtgctgttagccaagacagtcgctgtcaatgccctcccatacttgtggaaagccagcagaggtaaggcatcatactggtactttttcgagcagtccgtgttcaagaacccaaacaacaaagcgttggcgttcccaagaccaagaaagaatgcccccacccccaagaccgacgccgagggattccagatctacgacgatcagtttgacctagaagaatacacctacaaggaattgtacgacatggttttgaagtactcatacatcttgaagaacgagtacggcgtcactgccaacgacaccatcggtgtttcttgtatgaacaagccgcttttcattgtcttgtggttggcattgtggaacattggtgccttgcctgcgttcttgaacttcaacaccaaggacaagccattgatccactgtcttaagattgtcaacgcttcgcaagttttcgttgacccggactgtgattccccaatcagagataccgaggctcagatcagagaggaattgccacatgtgcaaataaactacattgacgagtttgccttgtttgacagattgagactcaagtcgactccaaaacacagagccgaggacaagaccagaagaccaaccgatactgactcctccgcttgtgcattgatttacaccgcgggtaccaccggtttgccaaaagccggtatcatgtcctggagaaaagccttcatggcctcggttttctttggccacatcatgaagattgactcgaaatcgaacgtcttgaccgccatgcccttgtaccactccaccgcggccatgttggggttgtgtcctactttgattgtcggtggctgtgtctccgtgtcccagaaattctccgctacttcgttctggacccaggccagattatgtggtgccacccacgtgcaatacgtcggtgaggtctgtcgttacttgttgaactccaagcctcatccagaccaagacagacacaatgtcagaattgcctacggtaacgggttgcgtccagatatatggtctgagttcaagcgcagattccacattgaaggtatcggtgagttctacgccgccaccgagtcccctatcgccaccaccaacttgcagtacggtgagtacggtgtcggcgcctgtcgtaagtacgggtccctcatcagcttgttattgtctacccagcagaaattggccaagatggacccagaagacgagagtgaaatctacaaggaccccaagaccgggttctgtaccgaggccgcttacaacgagccaggtgagttgttgatgagaatcttgaaccctaacgacgtgcagaaatccttccagggttattatggtaacaagtccgccaccaacagcaaaatcctcaccaatgttttcaaaaaaggtgacgcgtggtacagatccggtgacttgttgaagatggacgaggacaaattgttgtactttgtcgacagattaggtgacactttccgttggaagtccgaaaacgtctccgccaccgaggtcgagaacgaattgatgggctccaaggccttgaagcagtccgtcgttgtcggtgtcaaggtgccaaaccacgaaggtagagcctgttttgccgtctgtgaagccaaggacgagttgagccatgaagaaatcttgaaattgattcactctcacgtgaccaagtctttgcctgtgtatgctcaacctgcgttcatcaagattggcaccattgaggcttcgcacaaccacaaggttcctaagaaccaattcaagaaccaaaagttgccaaagggtgaagacggcaaggatttgatctactggttgaatggcgacaagtaccaggagttgactgaagacgattggtctttgatttgtaccggtaaagccaaattgtag

SEQ ID NO: 148 - protein, 650 aa, Candida sp.
MSGLEIAAAAILGSQLLEAKYLIADDVSLAKTVAVNALPYLWKASRGKASYWYFFEQSVFKNPNNKALAFPRPRKNAPTPKTDAEGFQIYDDQFDLEEYTYKELYDMVLKYSYILKNEYGVTANDTIGVSCMNKPLFIVLWLALWNIGALPAFLNFNTKDKPLIHCLKIVNASQVFVDPDCDSPIRDTEAQIREELPHVQINYIDEFALFDRLRLKSTPKHRAEDKTRRPTDTDSSACALIYTAGTTGLPKAGIMSWRKAFMASVFFGHIMKIDSKSNVLTAMPLYHSTAAMLGLCPTLIVGGCVSVSQKFSATSFWTQARLCGATHVQYVGEVCRYLLNSKPHPDQDRHNVRIAYGNGLRPDIWSEFKRRFHIEGIGEFYAATESPIATTNLQYGEYGVGACRKYGSLISLLLSTQQKLAKMDPEDESEIYKDPKTGFCTEAAYNEPGELLMRILNPNDVQKSFQGYYGNKSATNSKILTNVFKKGDAWYRSGDLLKMDEDKLLYFVDRLGDTFRWKSENVSATEVENELMGSKALKQSVVVGVKVPNHEGRACFAVCEAKDELSHEEILKLIHSHVTKSLPVYAQPAFIKIGTIEASHNHKVPKNQFKNQKLPKGEDGKDLIYWLNGDKYQELTEDDWSLICTGKAKL

SEQ ID NO: 149 - DNA, 1953 bp, Candida sp.
atgtcaggattagaaatagccgctgctgccatccttggtagtcagttattggaagccaaatatttaattgccgacgacgtgctgttagccaagacagtcgctgtcaatgccctcccatacttgtggaaagccagcagaggtaaggcatcatactggtactttttcgagcagtccgtgttcaagaacccaaacaacaaagcgttggcgttcccaagaccaagaaagaatgcccccacccccaagaccgacgccgagggattccagatctacgacgatcagtttgacctagaagaatacacctacaaggaattgtacgacatggttttgaagtactcatacatcttgaagaacgagtacggcgtcactgccaacgacaccatcggtgtttcttgtatgaacaagccgcttttcattgtcttgtggttggcattgtggaacattggtgccttgcctgcgttcttgaacttcaacaccaaggacaagccattgatccactgtcttaagattgtcaacgcttcgcaagttttcgttgacccggactgtgattccccaatcagagataccgaggctcagatcagagaggaattgccacatgtgcaaataaactacattgacgagtttgccttgtttgacagattgagactcaagtcgactccaaaacacagagccgaggacaagaccagaagaccaaccgatactgactcctccgcttgtgcattgatttacacctcgggtaccaccggtttgccaaaagccggtatcatgtcctggagaaaagccttcatggcctcggttttctttggccacatcatgaagattgactcgaaatcgaacgtcttgaccgccatgcccttgtaccactccaccgcggccatgttggggttgtgtcctactttgattgtcggtggctgtgtctccgtgtcccagaaattctccgctacttcgttctggacccaggccagattatgtggtgccacccacgtgcaatacgtcggtgaggtctgtcgttacttgttgaactccaagcctcatccagaccaagacagacacaatgtcagaattgcctacggtaacgggttgcgtccagatatatggtctgagttcaagcgcagattccacattgaaggtatcggtgagttctacgccgccaccgagtcccctatcgccaccaccaacttgcagtacggtgagtacggtgtcggcgcctgtcgtaagtacgggtccctcatcagcttgttattgtctacccagcagaaattggccaagatggacccagaagacgagagtgaaatctacaaggaccccaagaccgggttctgtaccgaggccgcttacaacgagccaggtgagttgttgatgagaatcttgaaccctaacgacgtgcagaaatccttccagggttattatggtaacaagtccgccaccaacagcaaaatcctcaccaatgttttcaaaaaaggtgacgcgtggtacagatccggtgccttgttgaagatggacgaggacaaattgttgtactttgtcgacagattaggtgacactttccgttggaagtccgaaaacgtctccgccaccgaggtcgagaacgaattgatgggctccaaggccttgaagcagtccgtcgttgtcggtgtcaaggtgccaaaccacgaaggtagagcctgttttgccgtctgtgaagccaaggacgagttgagccatgaagaaatcttgaaattgattcactctcacgtgaccaagtctttgcctgtgtatgctcaacctgcgttcatcaagattggcaccattgaggcttcgcacaaccacaaggttcctaagaaccaattcaagaaccaaaagttgccaaagggtgaagacggcaaggatttgatctactggttgaatggcgacaagtaccaggagttgactgaagacgattggtctttgatttgtaccggtaaagccaaattgtag

SEQ ID NO: 150 - protein, 650 aa, Candida sp.
MSGLEIAAAAILGSQLLEAKYLIADDVSLAKTVAVNALPYLWKASRGKASYWYFFEQSVFKNPNNKALAFPRPRKNAPTPKTDAEGFQIYDDQFDLEEYTYKELYDMVLKYSYILKNEYGVTANDTIGVSCMNKPLFIVLWLALWNIGALPAFLNFNTKDKPLIHCLKIVNASQVFVDPDCDSPIRDTEAQIREELPHVQINYIDEFALFDRLRLKSTPKHRAEDKTRRPTDTDSSACALIYTSGTTGLPKAGIMSWRKAFMASVFFGHIMKIDSKSNVLTAMPLYHSTAAMLGLCPTLIVGGCVSVSQKFSATSFWTQARLCGATHVQYVGEVCRYLLNSKPHPDQDRHNVRIAYGNGLRPDIWSEFKRRFHIEGIGEFYAATESPIATTNLQYGEYGVGACRKYGSLISLLLSTQQKLAKMDPEDESEIYKDPKTGFCTEAAYNEPGELLMRILNPNDVQKSFQGYYGNKSATNSKILTNVFKKGDAWYRSGALLKMDEDKLLYFVDRLGDTFRWKSENVSATEVENELMGSKALKQSVVVGVKVPNHEGRACFAVCEAKDELSHEEILKLIHSHVTKSLPVYAQPAFIKIGTIEASHNHKVPKNQFKNQKLPKGEDGKDLIYWLNGDKYQELTEDDWSLICTGKAKL

SEQ ID NO: 151 - DNA, 1283 bp, Candida sp.
atgtctgaatcaaccgttggaaaagtatgtcaccttaacaattgagtctcgtaattgctcgccattgggaaatcatcggctgtatttataatccagatctttcctaccctagtagttaccacagaacaattgcaacagaataaatactaacctttttgtcttagccaatcacctgtaaagccgctgttgcctgggaagcaggcaagcctttgaccatcgaagacgtcactgttgctccaccaaaggcccacgaagtgcgtatcaagatcttgtacactggtgtctgtcacactgatgcctacaccttgagtggtgttgatccagagggtgccttcccagtcatcttgggacacgaaggtgccggtattgttgaaagtgttggtgaaggtgtcaccactgtcaagccaggcgaccacgtcattgcattatacactccagaatgtggtgagtgtaagttctgtaaatcgggtaagaccaacttgtgtggtaaaatcagagctacccaaggcaaaggtgtgatgccagacggaactccaagattcacttgcaagggcaaagaattgattcactttatgggatgctccaccttctcccaatacaccgttgtcactgacatttccgtcgtggccatcaacgacaaagccgaacttgacaaggcttgtttgttgggatgtggtatcactactggttatggtgctgccaccatcactgccaatgttcaaaagggtgacaatgtcgcagttttcggtggtggtgctgtcggattgtccgtcctccaaggatgtaaagaaagagaagctgcccaaatcattttggttgatgtcaacaacaagaagaaggaatggggtgaaaagttcggtgccactgcttttatcaacccattagaattaccaaaaggcgtcactattgttgacaagttgattgaaatgactgacggtggttgtgactttacttttgactgtaccggtaatgtcaatgttatgagagatgccttggaagcttgtcataagggttggggtacttcagtcatcatcggtgttgccgctgccggtaaggaaatctccaccagaccattccaattggtcactggtagagtctggaagggtgctgctttcggtggcgtcaagggtagatcccaattgccaggaatcgttgaagactacatggttggtaagttgaaggttgaagagtttatcacccacagaaaaccattggaacaaatcaatgaagcatttgaagacatgcatgctggtgattgtattagagctgttgtcaacatgtgg

SEQ ID NO: 152 - protein, 350 aa, Candida sp.
MSANIPKTQKAVVFEKNGGELEYKDIPVPTPKANELLINVKYSGVCHTDLHAWKGDWPLATKLPLVGGHEGAGVVVGMGENVKGWKIGDFAGIKWLNGSCMSCEFCQQGAEPNCGEADLSGYTHDGSFEQYATADAVQAARIPAGTDLAEVAPILCAGVTVYKALKTADLAAGQWVAISGAGGGLGSLAVQYAVAMGLRVVAIDGGDEKGAFVKSLGAEAYIDFLKEKDIVSAVKKATDGGPHGAINVSVSEKAIDQSVEYVRPLGKVVLVGLPAGSKVTAGVFEAVVKSIEIKGSYVGNRKDTAEAVDFFSRGLIKCPIKIVGLSELPQVFKLMEEGKILGRYVLDTSK

SEQ ID NO: 153 - DNA, 1050 bp, Candida sp.
atgtctgctaatatcccaaaaactcaaaaagctgtcgtctttgagaagaacggtggtgaattagaatacaaagatatcccagtgccaaccccaaaggccaacgaattgctcatcaacgtcaaatactcgggtgtctgccacactgatttgcacgcctggaagggtgactggccattggccaccaagttgccattggttggtggtcacgaaggtgctggtgtcgttgtcggcatgggtgaaaacgtcaagggctggaagattggtgacttcgccggtatcaaatggttgaacggttcctgtatgtcctgtgagttctgtcaacaaggtgctgaaccaaactgtggtgaggccgacttgtctggttacacccacgatggttctttcgaacaatacgccactgctgatgctgttcaagccgccagaatcccagctggtactgatttggccgaagttgccccaatcttgtgtgcgggtgtcaccgtctacaaagccttgaagactgccgacttggccgctggtcaatgggtcgctatctccggtgctggtggtggtttgggttccttggctgtccaatacgccgtcgccatgggcttgagagtcgttgccattgacggtggtgacgaaaagggtgcctttgtcaagtccttgggtgctgaagcctacattgatttcctcaaggaaaaggacattgtctctgctgtcaagaaggccaccgatggaggtccacacggtgctatcaatgtttccgtttccgaaaaagccattgaccaatccgtcgagtacgttagaccattgggtaaggttgttttggttggtttgccagctggctccaaggtcactgctggtgttttcgaagccgttgtcaagtccattgaaatcaagggttcctatgtcggtaacagaaaggataccgccgaagccgttgactttttctccagaggcttgatcaagtgtccaatcaagattgttggcttgagtgaattgccacaggtcttcaagttgatggaagaaggtaagatcttgggtagatacgtcttggatacctccaaa

SEQ ID NO: 154 - protein, 350 aa, Candida sp.
MSANIPKTQKAVVFEKNGGELKYKDIPVPTPKANELLINVKYSGVCHTDLHAWKGDWPLDTKLPLVGGHEGAGVVVGMGENVKGWKIGDFAGIKWLNGSCMSCEFCQQGAEPNCGEADLSGYTHDGSFEQYATADAVQAARIPAGTDLAEVAPILCAGVTVYKALKTADLAAGQWVAISGAGGGLGSLAVQYAVAMGLRVVAIDGGDEKGDFVKSLGAEAYIDFLKEKGIVAAVKKATDGGPHGAINVSVSEKAIDQSVEYVRPLGKVVLVGLPAGSKVTAGVFEAVVKSIEIKGSYVGNRKDTAEAVDFFSRGLIKCPIKIVGLSELPQVFKLMEEGKILGRYVLDTSK

SEQ ID NO: 155 - DNA, 1254 bp, Candida sp.
atgcatgcattattctcaaaatcagtttttctcaagtatgtgagtctgcccactacctctgctatcccccattccctagaattcattgtctcccgaagctcctatttaaggagacgaattcccccatatcttccacgttgctcccactttccttccttctattattcttcttcttcagtctacaccaagaaatcatttcacacaatgtctgctaatatcccaaaaactcaaaaagctgtcgtcttcgagaagaacggtggtgaattaaaatacaaagacatcccagtgccaaccccaaaggccaacgaattgctcatcaacgtcaagtactcgggtgtctgtcacactgatttgcacgcctggaagggtgactggccattggacaccaaattgccattggttggtggtcacgaaggtgctggtgttgttgtcggcatgggtgaaaacgtcaagggctggaaaatcggtgatttcgccggtatcaaatggttgaacggttcttgtatgtcctgtgagttctgtcagcaaggtgctgaaccaaactgtggtgaagctgacttgtctggttacacccacgatggttctttcgaacaatacgccactgctgatgctgtgcaagccgccagaatcccagctggcactgatttggccgaagttgccccaatcttgtgtgctggtgtcaccgtctacaaagccttgaagactgccgacttggctgctggtcaatgggtcgctatctccggtgctggtggtggtttgggctccttggctgtccaatacgccgtcgccatgggtttgagagtcgttgccattgacggtggtgacgaaaagggtgactttgtcaagtccttgggtgctgaagcctacattgatttcctcaaggaaaagggcattgttgctgctgtcaagaaggccactgatggcggtccacacggtgctatcaatgtttccgtttccgaaaaagccattgaccaatctgtcgagtacgttagaccattgggtaaggttgttttggttggtttgccagctggctccaaggtcactgctggtgttttcgaagccgttgtcaagtccattgaaatcaagggttcttacgtcggtaacagaaaggatactgccgaagccgttgactttttctccagaggcttgatcaagtgtccaatcaagattgtgggcttgagtgaattgccacaggtcttcaagttgatggaagaaggtaagatcttgggtagatacgtcttggatacctccaaa

SEQ ID NO: 156 - protein, 640 aa, Saccharomyces cerevisiae; identical to SEQ ID NO: 101

SEQ ID NO: 157 - protein, 499 aa, Scheffersomyces stipitis
MSFDPFGSTATIVVFGASGDLAKKKTFPALFGLFREGHLSSDVKIIGYARSHLEEDDFKKRISANFKGGNPETVEQFLKLTSYISGPYDTDEGYQTLLKSIEDYEAANNVSTPERLFYLALPPSVFTTVASQLKKNVYSETGKTRIIVEKPFGHDLESSRQLQKDLSPLFTEEELYRIDHYLGKEMVKNLLVLRFGNELFNGVWNKNHIKSIQISFKEAFGTDGRGGYFDSIGIVRDVMQNHLLQVLTLLTMDRPVSFDPEAVRDEKVKILKAFDALDPEDILLGQYGKSEDGSKPGYLDDSTVPKDSKCVTYAALGIKIHNERWEGVPIVMRAGKALDESKVEIRIQFKPVARGMFKEIQRNELVIRVQPNESIYLKINSKIPGISTETSLTDLDLTYSTRYSKDFWIPEAYEALIRDCYLGNHSNFVRDDELDVSWKLFTPLLQYIESDKSPQPEVYAYGSKGPKGLREFLNKHDYIFADEGTYQWPLTTPKVKGKI

SEQ ID NO: 158 - protein, 718 aa, Candida sp.
MPALFKDSAQHILDTIKSELPLDPLKTAYAVPLENSAEPGYSAIYRNKYSTDKLIDTPYPGLDTLYKLFEVSTEANGDKPCLGGRVKNADGTFGEYKFQDYNTIHQRRNNLGSGIFFVLQNNPYKTNSEAHSKLKYDPTSKDSFILTIFSHNRPEWALCDLTSIAYSITNTALYDTLGPDTSKYILGLTESPIVVCSKDKIRGLIDLKKNNPDELSNLIVLVSMDDLTTADASLKNYGSEHNVTVYDIKQVEKLGEINPLDPIEPTPDTNFTITFTSGTTGANPKGVLLNHRNAVAGVTFVLSRYDGQFNPTAYSFLPLAHIYERASIQFALTIGSAIGFPQGPSPLTLIEDAKVLQPDGLALVPRVLTKLEAAIRAQTVNNDEKPLVKSVFGAAINAKMEAQMKEENENFNPSFIVYDRLLNLLRKKVGLQKVSQISTGSAPISPSTIQFLKASLNVGILQGYGLSESFAGCMASSKFEPAAVTCGPPGITTEVKLKDLEEMGYTSKDEGGPRGELLLRGPQIFKEYFKNPEETAEAIDEDGWFHTGDVAKINNKGRISIIDRAKNFFKLAQGEYVTPEKIEGLYLSKFPYIAQIFVHGDSKESYLVGVVGLDPVAGKQYMESRFHDKIIKEEDVVEFFKSPRNRKILLQDMNKSIADQLQGFEKLHNIYVDFDPLTVERGVITPTMKIRRPLAAKFFQDQIDAMYSEGSLVRNGSL

SEQ ID NO: 159 - protein, 718 aa, Candida sp.
MPALFKDSAKHIFDTIKSELPLDPLKTAYAVPLENSAEPGYSAIYRNKYSIDKLIDTPYPGLDTLYKLFEVATEAYGDKPCLGARVKNADGTFGEYKFQDYNTIHQRRNNFGSGIFFVLQNNPYKTDSEAHSKLKYDPTSKDSFILTIFSHNRPEWALCDLTSIAYSITNTALYDTLGPDTSKYILGLTESPIVICSKDKIRGLIDLKKNNPDELSNLIVLVSMDDLTTADASLKNYGSEHNVTVFDIKQVEKLGEINPLDPIEPTPDTNFTITFTSGTTGANPKGVLLNHRNAVAGVTFVLSRYDGHFNPTAYSFLPLAHIYERASIQFALTIGSAIGFPQGPSPLTLIEDAKVLQPDGLALVPRVLTKLEAAIRAQTVNNDEKPLVKSVFGAAINAKMEAQMKEENENFNPSFIVYDRLLNLLRKKVGLQKVTQISTGSAPISPSTIQFLKASLNVGILQGYGLSESFAGCMASSKFEPAAATCGPTGVTTEVKLKDLEEMGYTSKDEGGPRGELLLRGPQIFKGYFKNPEETAKAIDEDGWFHTGDVAKINDKGRISIIDRAKNFFKLAQGEYVTPEKIEGLYLSKFPYIAQLFVHGDSKESYLVGVVGLDPVAGKQYMESRFHDKIIKEEDVVEFFKSPRNRKILVQDMNKSIADQLQGFEKLHNIYVDFDPLTVERGVITPTMKIRRPLAAKFFQDQIDAMYSEGSLVRNGSL

SEQ ID NO: 160 - DNA, 4262 bp, Artificial Sequence
  Description of Artificial Sequence: Synthetic polynucleotide
aaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcgagttcggcatggcagatcatcatgcctgcaggagctccaattgtaatatttcgggagaaatatcgttggggtaaaacaacagagagagagagggagagatggttctggtagaattataatctggttgttgcaaatgctactgatcgactctggcaatgtctgtagctcgctagttgtatgcaacttaggtgttatgcatacacacggttattcggttgaattgtggagtaaaaattgtctgagttgtgtcttagctactggctggccccccgcgaaagataatcaaaattacacttgtgaatttttgcacacacaccgattaacatttcccttttttgtccaccgatacacgcttgcctcttcttttttttctctgtgcttccccctcctgtgactttttccaccattgatataaaatcaactccatttccctaaaatctccccagattctaaaaacaacttcttctcttctgcttttcctttttttttgttatatttatttaccatcccttttttttgaatagttattccccactaacattgttcaaatcttcacgacataagaagagcccgggtctagatgtgtgctcttccgagtgactcttttgataagagtcgcaaatttgatttcataagtatatattcattatgtaaagtagtaaatggaaaattcattaaaaaaaaagcaaatttccgttgtatgcatactccgaacacaaaactagccccggaaaaacccttagttgatagttgcgaatttaggtcgaccatatgcgacgggtacaacgagaattgtattgaattgatcaagaacatgatcttggtgttacagaacatcaagttcttggaccagactgagaatgcacagatatacaaggcgtcatgtgataaaatggatgagatttatccacaattgaagaaagagtttatggaaagtggtcaaccagaagctaaacaggaagaagcaaacgaagaggtgaaacaagaagaagaaggtaaataagtattttgtattatataacaaacaaagtaaggaatacagatttatacaataaattgccatactagtcacgtgagatatctcatccattccccaactcccaagaaaaaaaaaaagtgaaaaaaaaaatcaaacccaaagatcaacctccccatcatcatcgtcatcaaacccccagctcaattcgcaatggttagcacaaaaacatacacagaaagggcatcagcacacccctccaaggttgcccaacgtttattccgcttaatggagtccaaaaagaccaacctctgcgcctcgatcgacgtgaccacaaccgccgagttcctttcgctcatcgacaagctcggtccccacatctgtctcgtgaagacgcacatcgatatcatctcagacttcagctacgagggcacgattgagccgttgcttgtgcttgcagagcgccacgggttcttgatattcgaggacaggaagtttgctgatatcggaaacaccgtgatgttgcagtacacctcgggggtataccggatcgcggcgtggagtgacatcacgaacgcgcacggagtgactgggaagggcgtcgttgaagggttgaaacgcggtgcggagggggtagaaaaggaaaggggcgtgttgatgttggcggagttgtcgagtaaaggctcgttggcgcatggtgaatatacccgtgagacgatcgagattgcgaagagtgatcgggagttcgtgattgggttcatcgcgcagcgggacatggggggtagagaagaagggtttgattggatcatcatgacgcctggtgtggggttggatgataaaggcgatgcgttgggccagcagtataggactgttgatgaggtggttctgactggtaccgatgtgattattgtcgggagagggttgtttggaaaaggaagagaccctgaggtggagggaaagagatacagggatgctggatggaaggcatacttgaagagaactggtcagttagaataaatattgtaataaataggtctatatacatacactaagcttctaggacgtcattgtagtcttcgaagttgtctgctagtttagttctcatgatttcgaaaaccaataacgcaatggatgtagcagggatggtggttagtgcgttcctgacaaacccagagtacgccgcctcaaaccacgtcacattcgccctttgcttcatccgcatcacttgcttgaaggtatccacgtacgagttgtaatacaccttgaagaacggcttcgtctacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaa

SEQ ID NO: 161 - DNA, 7638 bp, Artificial Sequence
  Description of Artificial Sequence: Synthetic polynucleotide
  modified_base (6180)..(6180): a, c, t, g, unknown or other
  modified_base (6324)..(6324): a, c, t, g, unknown or other
  modified_base (6580)..(6580): a, c, t, g, unknown or other
gatctggaatccctcggcgtcggtcttgggggtgggggcattctttcttggtcttgggaacgccaacgctttgttgtttgggttcttgaacacggactgctcgaaaaagtaccagtatgatgccttacctctgctggctttccacaagtatgggagggcattgacagcgactgtcttggctaacagcacgtcgtcggcaattaaatatttggcttccaataactgactaccaaggatggcagcagcggctatttctaatcctgacatgtttctcgtacgtagtagtgaatgaagggaaggtggaataatatcaagggcgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatcaagcttggtaccgagctcggatccactagtaacggccgccagtgtgctggaattcgcccttccgttaaacaaaaatcagtctgtaaaaaaggttctaaataaatattctgtctagtgtacacattctcccaaaatagtgaaatccagctctacaatttggctttaccggtacaaatcaaagaccaatcgtcttcagtcaactcctggtacttgtcgccattcaaccagtagatcaaatccttgccgtcttcaccctttggcaacttttggttcttgaattggttcttaggaaccttgtggttgtgcgaagcctcaatggtgccaatcttgatgaacgcaggttgagcatacacaggcaaagacttggtcacgtgagagtgaatcaatttcaagatttcttcatggctcaactcgtccttggcttcacagacggcaaaacaggctctaccttcgtggtttggcaccttgacaccgacaacgacggactgcttcaaggccttggagcccatcaattcgttctcgacctcggtggcggagacgttttcggacttccaacggaaagtgtcacctaatctgtcgacaaagtacaacaatttgtcctcgtccatcttcaacaagtcaccggatctgtaccacgcgtcaccttttttgaaaacattggtgaggattttgctgttggtggcggacttgttaccataataaccctggaaggatttctgcacgtcgttagggttcaagattctcatcaacaactcacctggctcgttgtaagcggcctcggtacagaacccggtcttggggtccttgtagatttcactctcgtcttctgggtccatcttggccaatttctgctgggtagacaataacaagctgatgagggacccgtacttacgacaggcgccgacaccgtactcaccgtactgcaagttggtggtggcgataggggactcggtggcggcgtagaactcaccgataccttcaatgtggaatctgcgcttgaactcagaccatatatctggacgcaacccgttaccgtaggcaattctgacattgtgtctgtcttggtctggatgaggcttggagttcaacaagtaacgacagacctcaccgacgtattgcacgtgggtggcaccacataatctggcctgggtccagaacgaagtagcggagaatttctgggacacggagacacagccaccgacaatcaaagtaggacacaaccccaacatggccgcggtggagtggtacaagggcatggcggtcaagacgttcgatttcgagtcaatcttcatgatgtggccaaagaaaaccgaggccatgaaggcttttctccaggacatgataccggcttttggcaaaccggtggtacccgaggtgtaaatcaatgcacaagcggaggagtcagtatcggttggtcttctggtcttgtcctcggctctgtgttttggagtcgacttgagtctcaatctgtcaaacaaggcaaactcgtcaatgtagtttatttgcacatgtggcaattcctctctgatctgagcctcggtatctctgattggggaatcacagtccgggtcaacgaaaacttgcgaagcgttgacaatcttaagacagtggatcaatggcttgtccttggtgttgaagttcaagaacgcaggcaaggcaccaatgttccacaatgccaaccacaagacaatgaaaagcggcttgttcatacaagaaacaccgatggtgtcgttggcagtgacgccgtactcgttcttcaagatgtatgagtacttcaaaaccatgtcgtacaattccttgtaggtgtattcttctaggtcaaactgatcgtcgtagatccactagtaacggccgccagtgtgctggaattcgcccttgggctaacgaaaaggaaaccgctgacgttaaaggtatctacggttgtttcggtatgacccccggggatctgacgggtacaacgagaattgtattgaattgatcaagaacatgatcttggtgttacagaacatcaagttcttggaccagactgagaatgcacagatatacaaggcgtcatgtgataaaatggatgagatttatccacaattgaagaaagagtttatggaaagtggtcaaccagaagctaaacaggaagaagcaaacgaagaggtgaaacaagaagaagaaggtaaataagtattttgtattatataacaaacaaagtaaggaatacagatttatacaataaattgccatactagtcacgtgagatatctcatccattccccaactcccaagaaaaaaaaaaagtgaaaaaaaaaatcaaacccaaagatcaacctccccatcatcatcgtcatcaaacccccagctcaattcgcaatggttagcacaaaaacatacacagaaagggcatcagcacacccctccnaggttgcccaacgtttattccgcttaatggagtccaaaaagaccaacctctgcgcctcgatcgacgtgaccacaaccgccgagttcctttcgctcatcgacaagctcggtccccacatctgtctcgtgaagacgcacatcgatntcatctcagacttcagctacgagggcacgattgagccgttgcttgtgcttgcagagcgccacgggttcttgatattcgaggacaggaagtttgctgatatcggaaacaccgtgatgttgcagtacacctcgggggtataccggatcgcggcgtggagtgacatcacgaacgcgcacggagtgactgggaagggcgtcgttgaagggttgaaacgcggtgcggagggggtagaaaaggaaaggggcgtgttgatgtnggcggagttgtcgagtaaaggctcgttggcgcatggtgaatatacccgtgagacgatcgagattgcgaagagtgatcgggagttcgtgattgggttcatcgcgcagcgggacatggggggtagagaagaagggtttgattggatcatcatgacgcctggtgtggggttggatgataaaggcgatgcgttgggccagcagtataggactgttgatgaggtggttctgactggtaccgatgtgattattgtcgggagagggttgtttggaaaaggaagagaccctgaggtggagggaaagagatacagggatgctggatggaaggcatacttgaagagaactggtcagttagaataaatattgtaataaataggtctatatacatacactaagcttctaggacgtcattgtagtcttcgaagttgtctgctagtttagttctcatgatttcgaaaaccaataacgcaatggatgtagcagggatggtggttagtgcgttcctgacaaacccagagtacgccgcctcaaaccacgtcacattcgccctttgcttcatccgcatcacttgcttgaaggtatccacgtacgagttgtaatacaccttgaagaacggcttcgtctacggtcgacgacgggtacaacgagaattgtattgaattgatcaagaacatgatcttggtgttacagaacatcaagttcttggaccagactgagaatgcacagatatacaaggcgtcatgtgataaaatggatgagatttatccacaattgaagaaagagtttatggaaagtggtcaaccagaagctaaacaggaagaagcaaacgaagaggtgaaacaagaagaagaaggtaaataagtattttgtattatataacaaacaaagtaaggaatacagatttatacaataaattgccatactagtcacgtgagatatctcatccattccccaactcccaagaaaaaaaaaaagtgaaaaaaaaaatcaaacccaaagatcaacctccccatcatcatcgtcatcaaacccccagctcaattcgcagagctcggtacccggg

SEQ ID NO: 162 - DNA, 250 bp, Candida sp.
gtttgtctatgttttccgtttgccttttctttctagtacgagacgttattgaacgaagtttttatatatctagatctaatacatattccatgtctgttcatttttgacggagtttcataaggtggcagtttctaatcaaaggtccgtcattggcgtcgtggcattggcggctcgcatcaactcgtatgtcaatattttctgttaactccgccagacatacgatcaaaacctacaagcaaaaaaattccac

SEQ ID NO: 163 - DNA, 1483 bp, Artificial Sequence
  Description of Artificial Sequence: Synthetic polynucleotide
cgacgggtacaacgagaattgtattgaattgatcaagaacatgatcttggtgttacagaacatcaagttcttggaccagactgagaatgcacagatatacaaggcgtcatgtgataaaatggatgagatttatccacaattgaagaaagagtttatggaaagtggtcaaccagaagctaaacaggaagaagcaaacgaagaggtgaaacaagaagaagaaggtaaataagtattttgtattatataacaaacaaagtaaggaatacagatttatacaataaattgccatactagtcacgtgagatatctcatccattccccaactcccaagaaaaaaaaaaagtgaaaaaaaaaatcaaacccaaagatcaacctccccatcatcatcgtcatcaaacccccagctcaattcgcaatggttagcacaaaaacatacacagaaagggcatcagcacacccctccaaggttgcccaacgtttattccgcttaatggagtccaaaaagaccaacctctgcgcctcgatcgacgtgaccacaaccgccgagttcctttcgctcatcgacaagctcggtccccacatctgtctcgtgaagacgcacatcgatatcatctcagacttcagctacgagggcacgattgagccgttgcttgtgcttgcagagcgccacgggttcttgatattcgaggacaggaagtttgctgatatcggaaacaccgtgatgttgcagtacacctcgggggtataccggatcgcggcgtggagtgacatcacgaacgcgcacggagtgactgggaagggcgtcgttgaagggttgaaacgcggtgcggagggggtagaaaaggaaaggggcgtgttgatgttggcggagttgtcgagtaaaggctcgttggcgcatggtgaatatacccgtgagacgatcgagattgcgaagagtgatcgggagttcgtgattgggttcatcgcgcagcgggacatggggggtagagaagaagggtttgattggatcatcatgacgcctggtgtggggttggatgataaaggcgatgcgttgggccagcagtataggactgttgatgaggtggttctgactggtaccgatgtgattattgtcgggagagggttgtttggaaaaggaagagaccctgaggtggagggaaagagatacagggatgctggatggaaggcatacttgaagagaactggtcagttagaataaatattgtaataaataggtctatatacatacactaagcttctaggacgtcattgtagtcttcgaagttgtctgctagtttagttctcatgatttcgaaaaccaataacgcaatggatgtagcagggatggtggttagtgcgttcctgacaaacccagagtacgccgcctcaaaccacgtcacattcgccctttgcttcatccgcatcacttgcttgaaggtatccacgtacgagttgtaatacaccttgaagaacggcttcgtct

SEQ ID NO: 164 - DNA, 50 bp, Candida sp.
gttaactccgccagacatacgatcaaaacctacaagcaaaaaaattccac

SEQ ID NO: 165 - DNA, 531 bp, Candida sp.
gagctccaattgtaatatttcgggagaaatatcgttggggtaaaacaacagagagagagagggagagatggttctggtagaattataatctggttgttgcaaatgctactgatcgactctggcaatgtctgtagctcgctagttgtatgcaacttaggtgttatgcatacacacggttattcggttgaattgtggagtaaaaattgtctgagttgtgtcttagctactggctggccccccgcgaaagataatcaaaattacacttgtgaatttttgcacacacaccgattaacatttcccttttttgtccaccgatacacgcttgcctcttcttttttttctctgtgcttccccctcctgtgactttttccaccattgatataaaatcaactccatttccctaaaatctccccagattctaaaaacaacttcttctcttctgcttttcctttttttttgttatatttatttaccatcccttttttttgaatagttattccccactaacattgttcaaatcttcacgacata

SEQ ID NO: 166 - DNA, 536 bp, Candida sp.
gaagatgaagcgtatgagtattatgagtactgtcggacgttggaaggtggcagagttaagcccgagaaagcaaggaaggagtgggagatgatgagtgatgcggccaaagaggatgtgaaggctgcgtatctgtttttgatagctggtggtagccgaatagaggaaggcaagcttgttcatattggatgatgatggtagatggtggctgccaaagtggttgtaaatagaaaaaagtgggtttgggtctgttgatagttagtggtggcggctgtctgtgattacgtcagcaagtagcacctcggcagttaaaacagcagcaacagaaaaaaaatgtgtgaaagtttgattcccccacagtctaccacacccagagttccatttatccataatatcacaagcaatagaaaaataaaaaattatcaacaaatcacaacgaaaagattctgcaaaattattttcacttcttcttttgacttcctcttcttcttgttaggttctttccatattttccccttaaacccatacacaacgcagcc

SEQ ID NO: 167 - DNA, 500 bp, Candida sp.
ctagcaaaggcttgatcagagaaagcaacaaaaaaaaaaactctaatactccagaatacactcctttagaaacacacaacaaacaagcctagactaccatggactacgatgaagacgatttagattacatttctcaaggagaagaggaagagtttgacgaaaacaagttgaacaacgaagagtacgacttgttgcatgacatgcttccggagttgaagacaaaattgaaagattacaatgatgagatcccagattacgatttaaaggaagcgttatactacaactatttcgagatagaccctaccattgaagaattgaagacgaaattcaaaaagagtacgtatatacaactaacatcaacgcctttctagtttctgttctgtctccaatgcttctcctggtttcttcatggttctctctgtaccaacaaggaaaaaaaaaaaaatctggcaaaaaaaaccaaaccaaccaatgttcttactcaccaacgccctacaatc

SEQ ID NO: 168 - DNA, 250 bp, Candida sp.
atggctccatttttgcccgaccaggtcgactacaaacacgtcgacacccttatgttattatgtgacgggatcatccacgaaaccaccgtggacgaaatcaaagacgtcattgcccctgacttccccgccgacaaatacgaggagtacgtcaggacattcaccaaaccctccgaaaccccagggttcagggaaaccgtctacaacaccgtcaacgcaaacaccatggatgcaatccaccagttcattatct

SEQ ID NO: 169 - DNA, 991 bp, Candida sp.
ttgtccaatgtaataatttttccatgactaaaaagtgtgtgttggtgtaaagaagaaagtggaagggacgttggtgatggtgagttcgtctatcccttttttatagttgcttgtatagtaggctactcttctagggactcgatgggggaaggttcttgatatttgcttagttcgagaaggttccagatgagcgagacatttttggtacgacattgggtggatgatctgcacgacattttgtgattcttgcgacacgctgcactaccaagtgtagtctggctgaacggatcacaagataaacctctgaaaaattatctcagggcatgcaacaacaattatacatagaagagggagtcacgatatacacctgtgaaggaatcatgtggtcggctctccttgaactttgaattcatgcaattattaagaagaagcacaggtgagcaacccaccatacgttcatttgcaccacctgatgattaaaagccaaagaaagaaaaaaaaaaaagaaacaggcggtgggaattgttacaacccacgcgaacccgaaaatggagcaatcttccccggggcctccaaataccaactcacccgagagagagaaagagacaccacccaccacgagacggagtatatccaccaaggtaagtaactcagggttaatgatacaggtgtacacagctccttccctagccattgagtgggtatcacatgacactggcaggttacaaccacgtttagtagttattttgtgcaattccatggggatcaggaagtttggtttggtgggtgcgtctactgattcccctttgtctctgaaaatcttttccctagtggaacactttggctgaatgatataaattcaccttgattcccaccctcccttctttctctctctctctgttacacccaattgaattttcttttttttttttttactttccctccttctttatcatcaaagataagtaagtttatcaattgcctattcaga

SEQ ID NO: 170 - DNA, 4302 bp, Artificial Sequence
  Description of Artificial Sequence: Synthetic polynucleotide
ggtttgattggatcatcatgacgcctggtgtggggttggatgataaaggcgatgcgttgggccagcagtataggactgttgatgaggtggttctgactggtaccgatgtgattattgtcgggagagggttgtttggaaaaggaagagaccctgaggtggagggaaagagatacagggatgctggatggaaggcatacttgaagagaactggtcagttagaataaatattgtaataaataggtctatatacatacactaagcttctaggacgtcattgtagtcttcgaagttgtctgctagtttagttctcatgatttcgaaaaccaataacgcaatggatgtagcagggatggtggttagtgcgttcctgacaaacccagagtacgccgcctcaaaccacgtcacattcgccctttgcttcatccgcatcacttgcttgaaggtatccacgtacgagttgtaatacaccttgaagaacggcttcgtctacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcgagttcggcatggcagatcatcatgcctgcaggaagatgaagcgtatgagtattatgagtactgtcggacgttggaaggtggcagagttaagcccgagaaagcaaggaaggagtgggagatgatgagtgatgcggccaaagaggatgtgaaggctgcgtatctgtttttgatagctggtggtagccgaatagaggaaggcaagcttgttcatattggatgatgatggtagatggtggctgccaaagtggttgtaaatagaaaaaagtgggtttgggtctgttgatagttagtggtggcggctgtctgtgattacgtcagcaagtagcacctcggcagttaaaacagcagcaacagaaaaaaaatgtgtgaaagtttgattcccccacagtctaccacacccagagttccatttatccataatatcacaagcaatagaaaaataaaaaattatcaacaaatcacaacgaaaagattctgcaaaattattttcacttcttcttttgacttcctcttcttcttgttaggttctttccatattttccccttaaacccatacacaacgcagccagaagagcccgggtctagatgtgtgctcttccgctccaggcttgttatgactctagagagaagtgtgtgtgtgtgtgtgcgtttgttttactatacattcaacatgttctttttcttttttgatatttattccaactataattatacacagattcgtatatactttactttaccctctttcgtagttttttaatttgatgatttttgagtttcatatccaaggtcaaaacccgaccgaattcatatgcgacgggtacaacgagaattgtattgaattgatcaagaacatgatcttggtgttacagaacatcaagttcttggaccagactgagaatgcacagatatacaaggcgtcatgtgataaaatggatgagatttatccacaattgaagaaagagtttatggaaagtggtcaaccagaagctaaacaggaagaagcaaacgaagaggtgaaacaagaagaagaaggtaaataagtattttgtattatataacaaacaaagtaaggaatacagatttatacaataaattgccatactagtcacgtgagatatctcatccattccccaactcccaagaaaaaaaaaaagtgaaaaaaaaaatcaaacccaaagatcaacctccccatcatcatcgtcatcaaacccccagctcaattcgcaatggttagcacaaaaacatacacagaaagggcatcagcacacccctccaaggttgcccaacgtttattccgcttaatggagtccaaaaagaccaacctctgcgcctcgatcgacgtgaccacaaccgccgagttcctttcgctcatcgacaagctcggtccccacatctgtctcgtgaagacgcacatcgatatcatctcagacttcagctacgagggcacgattgagccgttgcttgtgcttgcagagcgccacgggttcttgatattcgaggacaggaagtttgctgatatcggaaacaccgtgatgttgcagtacacctcgggggtataccggatcgcggcgtggagtgacatcacgaacgcgcacggagtgactgggaagggcgtcgttgaagggttgaaacgcggtgcggagggggtagaaaaggaaaggggcgtgttgatgttggcggagttgtcgagtaaaggctcgttggcgcatggtgaatatacccgtgagacgatcgagattgcgaagagtgatcgggagttcgtgattgggttcatcgcgcagcgggacatggggggtagagaagaag

SEQ ID NO: 171 - skipped

SEQ ID NO: 172 - protein, 485 aa, Candida sp.
MLTPKDKKNKEDRPYKCTYCDKAFHRLEHQTRHIRTHTGEKPHACTFPGCVKRFSRSDELTRHLRIHTNPSSRKRKNKSQDLMGPTPMSINGQNLPPGSYAVTNTGIPFAIDRNGNHVYPQPYPVFFVPQPNGYMQPVVQAPGLSIVPPPPPQQQQQQGQAPQQQQQQLHSQQQQQRMGSPHSNMTTPTHLQQEGSAVFSIPSSPTNSYQNVPNRPNQQPLPPPQPVTMSTPMSTRSMSSDAIRLPPLTSNNSFQQQQQQQPRPPPTILKSESTTSKDSNRVFSQPNSNLHSLGTSPDTSPSAMPPPTVVPTPSFSNLNEYFQQKSNNPRIFNASSSSLSSLSGKIRSTSSTNLAGLQRLTPLVQTSTNSTPGKSIIPSQPSSTSLNLEFYNQGNASHASKKSRPNSPCQSAMNISSIMSSPSETPLQTPSQSPRLHNGPGNSSVIEGAQAKLESIATTGTQLPPIRSVLSFTNLSDYPPPPSNR

SEQ ID NO: 173 - protein, 504 aa, Saccharomyces cerevisiae
MQSPYPMTQVSNVDDGSLLKESKSKSKVAAKSEAPRPHACPICHRAFHRLEHQTRHMRIHTGEKPHACDFPGCVKRFSRSDELTRHRRIHTNSHPRGKRGRKKKVVGSPINSASSSATSIPDLNTANFSPPLPQQHLSPLIPIAIAPKENSSRSSTRKGRKTKFEIGESGGNDPYMVSSPKTMAKIPVSVKPPPSLALNNMNYQTSSASTALSSLSNSHSGSRLKLNALSSLQMMTPIASSAPRTVFIDGPEQKQLQQQQNSLSPRYSNTVILPRPRSLTDFQGLNNANPNNNGSLRAQTQSSVQLKRPSSVLSLNDLLVGQRNTNESDSDFTTGGEDEEDGLKDPSNSSIDNLEQDYLQEQSRKKSKTSTPTTMLSRSTSGTNLHTLGYVMNQNHLHFSSSSPDFQKELNNRLLNVQQQQQEQHTLLQSQNTSNQSQNQNQNQMMASSSSLSTTPLLLSPRVNMINTAISTQQTPISQSDSQVQELETLPPIRSLPLPFPHMD

SEQ ID NO: 174 - DNA, 1515 bp, Saccharomyces cerevisiae
atgcaaagcccatatccaatgacacaagtgtctaacgttgatgatgggtcactattgaaggagagtaaaagcaagtccaaagtagctgcgaagtcagaggcgccaagaccacatgcttgtcctatctgtcatagagcttttcacagactggaacatcagacgagacacatgagaattcatacaggtgagaagcctcacgcgtgtgacttccccggatgtgtgaaaaggttcagtagaagcgatgaactgacgagacacagaagaattcatacaaactcccaccctcgaggtaaaagaggcagaaagaagaaggttgtgggctctccaataaatagtgctagttctagtgctaccagtataccagatttaaatacggcaaatttttcaccgccattaccacagcaacacctatcgcctttaattcctattgctattgctccgaaagaaaattcaagtcgatcttctacaagaaaaggtagaaaaaccaaattcgaaatcggcgaaagtggtgggaatgacccatatatggtttcttctcccaaaacgatggctaagattcccgtctcggtgaagcctccaccttctttagcactgaataatatgaactaccaaacttcatccgcttccactgctttgtcttcgttgagcaatagccatagtggcagtagactgaaactgaacgcgttatcgtccctacaaatgatgacgcccattgctagcagtgcgccaaggactgttttcatagacggtcctgaacagaaacaactacaacaacaacaaaattctctttcaccacgttattccaacactgttatattaccaaggccgcgatctttaacggattttcaaggattgaacaatgcaaatccaaacaacaatggaagtctcagagcacaaactcagagttccgtacagttgaagagaccaagttcagttttaagtttgaacgacttgttggttggccaaagaaataccaacgaatctgactctgattttactactggtggtgaggatgaagaagacggactaaaggacccgtctaactctagtatcgataaccttgagcaagactatttgcaagagcaatcaagaaagaaatctaagacttccacgcccacgacaatgctaagtagatccactagtggtacgaatttgcacactttggggtatgtaatgaaccaaaatcacttgcatttctcctcatcatctcctgatttccaaaaggagttgaacaacagattactgaacgttcaacaacagcagcaagagcaacataccctactgcaatcacaaaatacgtcaaaccaaagtcaaaatcaaaatcaaaatcaaatgatggcttccagtagttcgttaagtacaaccccgttattattgtcaccaagggtgaatatgattaatactgctatatccacccaacaaacccccatttctcagtcggattcacaagttcaagaactggaaacattaccacccataagaagtttaccgttgcccttcccacacatggactga

SEQ ID NO: 175 - protein, 474 aa, Kluyveromyces lactis
MTEAIIEKKNHKKSINDHDKDGPRPYVCPICQRGFHRLEHQTRHIRTHTGERPHACDFPGCSKRFSRSDELTRHRRIHDSDKPKGKRGRKKKSETIAREKELELQRQKQRNANDSAAVDSAGGTSANVIEPNHKLLKSTNSIKQDGSTFTEPLKSLRSKPMFDLGSDESDECGIYSVPPIRSQNNSGNIDLLLNAAKFESDKASSSFKFIDKLPLTSSSSSPSLSFTSHSINNSSSGLLLPRPASRAKLSALSSLQRMTPLSQNSESYNHSQQNLVHLHHPAPNRPLTEFVDNEYISNGLPRTRSWTNLSEQQSPSGFSSSALNSRFSSSNSLNQLIDQHSRNSSTVSISTLLKQETVISQDEDMSTEDAYGRPLKKSKAIMPIMRPSSTMPPSSGSATEGEFYDELHSRLRSMDQLPVRNSKDEKDYYFQSHFSSLLCTPTHSPPPEGLLPSLNQNKPVQLPSLRSLDLLPPK

SEQ ID NO: 176 - DNA, 1425 bp, Kluyveromyces lactis
atgacagaggcgattatagagaaaaaaaatcataagaagtctatcaatgatcatgacaaggatggaccaaggccttacgtctgtcccatatgtcaaaggggattccatcgactggaacatcagactaggcacatcagaacacacactggggaaagaccgcatgcatgtgatttcccgggatgttcaaaacgctttagtagaagcgatgaactaacaagacatagaaggatacatgacagtgataaaccaaaggggaaaagaggaaggaaaaagaagagtgagacgatagctcgtgaaaaggaattagaattgcagcggcaaaaacaacgaaacgcaaacgactctgcggctgttgattctgctggtggaacgagcgctaatgtcatagaaccaaaccacaaacttctgaaatccactaattcgattaaacaagatggttcaacatttactgaacctctgaaatcgttgaggtcgaagccaatgtttgatctcggtagcgatgaatcggatgaatgcggtatatatagtgtcccacctattagatctcagaataatagtggtaacatagaccttctgctgaatgctgcaaaatttgagtctgacaaagcctcatcctctttcaaatttattgataaactaccgttgacttcatcttcatcctctccgtcactttcgtttacatctcattcaatcaacaacagcagtagcggactattgttaccaagaccagcttcacgtgctaagctttctgctttatcatcattacaaagaatgacacccttgtctcaaaattcagagtcatataatcattcgcaacagaatctagtacatcttcaccatcccgcacccaaccgaccattgaccgagtttgttgataacgagtatataagtaacggtctgcctagaaccagatcgtggacaaatctgtcggaacagcaatcaccatcgggcttcagctcctctgcacttaactccagattctcgtcatccaatagtctcaaccaactgatagatcaacattcaagaaattcaagtactgtaagcatatctactctactgaagcaagaaaccgtaatctcacaagatgaggatatgagtacagaagatgcatatggccggccacttaagaaatcaaaagccataatgcccatcatgagacctagttctacaatgccaccaagttccggctcagctacagaaggagaattttatgatgaacttcattcaaggcttagatcgatggatcaactgccggtaaggaacagtaaggacgaaaaagattactatttccaaagtcatttttcaagtttactgtgcactccaacgcacagtcctccaccggaaggattgttacccagtttgaatcagaataagccagtgcagttgccatcacttcgaagcttagaccttttaccaccaaaataa

SEQ ID NO: 177 - protein, 488 aa, Candida tropicalis
MNNQKMLSSKEKKNKEDRPYKCTYCDKAFHRLEHQTRHIRTHTGEKPHACTFPGCVKRFSRSDELTRHLRIHTNPSSRKRKNKNQDLVEPTPMNVPPGSYAVPNTAIPFSIDRNGNHVYHQPYPVFFVPQPNGYMQPVVQAPGLSIVPPPPHAHAQQAPQGPVPIQIQPPQPQRIASPHSNMSTPTHLQQEGSAVFSIPSSPTNSYQNAPNRQNLPQQPQPQPQITVQAVPMTTRSTSSDAIRLPPLTPNTTAQQPQPQRPQSAIFKSESNTSLYSDTSKVFSQPNSTLHSVGTSPDTSPSAMPPPIVVPAPSFSNLNEYFQQKSNNPRIFNASSSSLSSLSGKIRSTSSTNLAGLQRLTPLVPTTSTNTSNTTKSNIIPKQPSSTSLNLEFFNGNGTVGHANKKSRPNSPCQSAMNISSIMSSPNETPLQTPSQSPRLNASNGPQSNIIEAAQAKLESIATTGTQLPPIRSVLSFTNLSDYPQPTSN

SEQ ID NO: 178 - DNA, 1467 bp, Candida tropicalis
atgaataatcaaaaaatgttatcttctaaggagaaaaagaataaggaggatagaccttacaagtgtacttattgtgataaagcattccacagattggaacatcaaacaagacatattagaacccatactggtgaaaaacctcatgcgtgtacttttcctggatgtgttaaaagatttagtagatcagatgaactaacaagacatttaagaattcatactaatccaagttcaagaaagagaaagaataagaatcaagatttggttgaacctactccaatgaatgttcctccaggttcatatgctgttccaaacactgcaattccattttctattgatcgtaatggtaatcatgtctaccatcaaccatatccagtattttttgttcctcaaccaaatggttatatgcaacctgttgttcaagctccaggcctttctattgttccaccaccacctcatgcacatgcacaacaagcaccacaaggaccggttcctattcaaattcaaccacctcaaccacaacgcatagcaagtccacatagtaatatgtctactcctacacatttgcaacaagaaggttctgctgttttctcaattccttcatctcctacaaattcataccaaaatgctccaaatcgtcaaaacctaccacaacaaccacaaccacagccacaaattactgtccaagctgttccaatgactacaagatcaacatcatcagatgctattagattaccaccactaacaccaaacaccactgcccaacaaccacaacctcaacgtccacaatctgccattttcaaatcagaatctaatactagcctatactctgatactagtaaagtatttagtcaaccaaattctactttacattcagtaggtacatcaccagatacaagtccttctgcaatgccaccaccaattgttgttcctgctccttcttttagtaatttgaatgaatattttcaacaaaagagtaataatccaagaattttcaatgctagttcttcatctttaagttcattaagtggtaagattagatctacatcatctacaaatcttgcaggtttacaaagattgactccattagttccaacaactagtacaaatacttctaacactacaaaatctaatataatacccaaacagccttcatcaacttcattaaatttggaatttttcaatggtaatggaactgttggacatgcaaataagaaatcaagaccaaattcaccatgtcaatcagcaatgaatatttcttcaataatgagttcaccaaatgaaacaccattacaaacaccttcacaatcaccacgtttgaatgctagtaatggtcctcaaagtaacatcattgaagctgctcaagctaaattggaaagtatagctactacaggtactcaattaccaccaattagatcggttttaagttttactaatttgtcagattatccacaacccacgtcaaattag

SEQ ID NO: 179 - protein, 600 aa, Yarrowia lipolytica
MEFTATNSDREMHPPPVAVPSHLQQSTTHRTVPKTNPKTGKSEMPRPYKCPICDKAFHRLEHQTRHIRTHTGEKPHECTFPGCTKRFSRSDELTRHSRIHLNPNTRRAKNMNSAAAAAHNAAAQQKGPPSNQQPKDDRTDRLVAISNLVDHHDAHPPIPGGSGIKSEYSSAYSTPYSSVPSSPTMGQASLYRPYGAGPGGPPPPGGPGGLGGPAPPGPPGHHGGPPTHIGLPPLHHPPPPGGPHSAAPSAPNSTPGSPMFVRVPHSTYPRSTFDMNMLATAASQQLERENAPPSGLSSGAPSAAPSGTSSPFNHSPSSSPLQSTQSSPALASYFSRPPAPSSNPGTPGSSHGPPYGFSSGTSLSSHGNTHSNHFQHPQHLHPPHHHHGLQGHIFAGLQRMTPMSGRDDSEPWHRSKKSRPNSPSSTAPSSPTFSNSESPTPDHTPLATPAHSPRIHPRDLEGVQLPSIRSLSIGRHVPPTLPPMEIAPRSSGGTHTGTHTPYGGGSASHTPFGTSPNSGVPPPHPNAAQGAASSLSMLAMAGLNHAAGGAAPGGSGAAATSSTRDEPSNDTSGPASGSGPSAPSTASSSTRMAVSDLIDR

SEQ ID NO: 180 - DNA, 1803 bp, Yarrowia lipolytica
atggaattcacagccaccaattcagaccgagaaatgcaccctcccccggtggcagtgccgtcgcatctgcagcagtccacgacccaccgcacggtgcccaaaaccaaccccaagacgggcaagtccgaaatgccccgaccctacaagtgccccatctgcgacaaggccttccaccggctggagcatcagacccgccacatccggacacacacgggcgagaagccccacgagtgcaccttcccaggttgcaccaagcggttcagccgtagcgacgagctcacccgacactcgcgcatacatttaaatcccaacactagacgggccaagaacatgaacagcgccgccgccgccgctcacaatgccgccgctcagcagaagggccctccttctaaccagcagcccaaggacgaccgaacagaccgccttgtggccatcagtaatctcgtcgaccaccacgacgcccaccctcctattcccggaggcagtggtatcaagagcgagtactcgtccgcatactcgactccatattcttcggtgccgtcgtcgccaaccatgggacaggcctcgttgtacagaccttatggtgctggtccaggcggtcctcctcctcctggtggacctggtggactgggtggacctgctcctcctggccctcccggccaccatggaggaccccccactcacataggtctaccacccctacaccatcctcctcctccaggaggccctcattcggccgcgcccagtgctcccaacagtacgcccgggtcgcccatgtttgtgcgagtgccacattcaacctacccaagatcgactttcgacatgaacatgctcgcgactgcggcctctcagcagctcgagcgcgagaacgcgcctccatcgggtctgtcttctggtgctccctcggctgcgccttccggcacctccagccccttcaaccattcaccctcgtcgtcgccactgcagtccacgcagtcgtcccccgctctggcgtcgtatttcagtcggcctcctgctccgtcttccaaccccggaacccccggtagctcgcacggtcctccctacggcttctcgtcgggcacgtcgctgtcgtcgcatggaaacacgcactccaatcacttccagcacccacaacacttgcatcccccgcatcatcaccatggtctgcagggacacatctttgcgggtctgcagcgcatgacgcccatgtctggaagagacgactcggagccatggcaccggtctaagaagtcgcgccccaactcaccgtcttctactgcaccgtcgtcgcccactttcagcaactcggagagccccacgccggaccacacgcccctggcgacccccgcacattcgcctcgaatccaccctcgagatctcgagggagtgcagctgccttccattcggtcgctgtcgattggccgccacgtgccccccacgctaccgcctatggagattgcgcctcggtcaagtggaggcacccataccggcacccatacgccgtacggcggcggatctgcgtcgcacacgccgtttggcacatcacccaactcgggagttcctcctccgcatccaaacgcggcccagggcgctgcttcttcgcttagcatgctagccatggctggcctgaaccacgctgctgggggagctgctcctggaggcagtggggcggcagctacgtcgtcgacgcgcgacgagcccagcaacgatacatctgggcctgcgtcaggcagcgggccttctgctccgtccaccgcgtcgtccagtactcgaatggccgtcagtgacttgattgatagatga

SEQ ID NO: 181 - protein, 1012 aa, Candida sp.
MSSSDEGDHTPELQQEKVTQNTHSDAPSATPQTTPAQTTTTTTTTTSSSQTTTTKKPKSDTKDKPKAFTIKYKRPRGSRACTVCRSRKVRCDAEIHIPCTNCITFGCECILPEAKKRGNQSGESKAKRQKTQPKDKAATTAASTKKKATTTTTTENGDEDGSPLEQTSSSRSAKSPDLVTPTKESETSSHTSSTAEPIINISQVSVPPSLTSTYKNRPSMHKKELLDSKAKTALTFLGSSSIGVVPQRVGENHVELTTDVFDTSDIKLDSVELEILKMRGAFLLPSKELSLELINAYFEHVHPLMPVINRSLFMKKFNDPNDNPSLMVLHAVLLLGCRASKNPLLLDSNGTNDLASITFFRRAKALYETNYESDPVSIIQTLILIGSYWDGPEDVTKNSFYWTRVAVGLAQGFGFQRDVSKSHQLTVSEKKIWRRIWWCLFEKDRNVAIAFGRPVVIDLNDCDVPMLTVDDFDETDPELGITDPYPVNETQALYFIHLVKLAEITGIIIKHQYSVKSETMKRRNAFSIIEHCDMLMGIWFTNLPSNLVFSLADSSTHNFFACLLNAQYYNRLYLIHRSNLIRMARSSSTNPNNYKYPSWGISFQSARMISIISKILMDKDLIQFVPVMYVYIAFSALVMLIYHVDSANSVIAATASDSLFVSRAVLRELQKAWPVAAVLLKLFDKYANDKLKRTKLIENGNMIVEYKENAAKEKMKKSINEYGTNTSPTAMPIPNRSPLSQPQQQPQQQQQHRQVVQQQLPLPQPAKPRDRTLFSPSSVTSGVSPGGNVYNNYSEQTPVKQEFSSVSPVAANPPQQQVQGSNPTPQIEELVKQYKLPMKRAAKANNGNGDSSDKQTTDTSPASSTKSFPDISMVTENLQNKQNFFENFEPTQLFPTFSIPPTRAQSPTPNFDDGAIGSNVYNTMNTTMEIKEERTPQPQQSGENQQEQPHNGNAAASLAAPAQTLKDEHDILDLHTPGFQTNFIDSSFNYLNLQSGMNMDEDIHSLFNMMNQ

SEQ ID NO: 182 - protein, 1022 aa, Candida tropicalis
MSDQKDGVAKLDQQKETENSHPETQTATTTTTTTATQTTSTTSNKKPKSDAKDKPKAFTIKYKRPRGSRACTVCRSRKVRCDAEIHIPCTNCITFGCECILPEAKKRGNQSGESKAKRQKVNQSKDKPLSATALKKKSSSNSTINTPINENGNSLEKSTSPVSNNKSSDMATTMSSNNDTSENSNTTSTAEPIINISQVSVPPSLTSTYKNRPSMHKKELLDSKAKTALTFLGSSSIGVVPQRAGENHVELTTDVFDTSDTKLDSVELEILKMRGAFLLPSKELSLELINAYFEHVHPLMPVINRSLFMKKFNDPNDNPSLMVLHAVLLLGCRASKNPLLLDSKGTNDLASITFFRRAKALYETNYESDPVSIIQTVILIGSYWDGPEDVTKNSFYWTRVAVGLAQGFGFQRDVSKSHQLTISEKKIWRRIWWCLFEKDRNVAIAFGRPVVIDLNDCDVPMLTVEDFDETDPELGIVDPYPINETQALYFIHLVKLAEITGIIIKHQYSVKSETMKRRNAFSIIEHCDMLMGIWFTNLPSKLVFSLADTSTHNFYACLLNAQYYNRLYLIHRSNLIRMARSSSTNPNNYKYPSWGISFQSARMISIISKILLDRNLIQYVPVMYVYIAFSALVMLIYHVDSDNSVIAATAADSLYVSRAVLKELSKYWPVAGVLLKLFDKYANDKLKRTRLIENGNMIVEYKENAAKEKMKQSIGEYDSHSSSATMSIPNRQQQQQQASPLPQNRQSQQPLPLPQTAKSKDHTMFSPTSATSGISPGGGVYNGYPDQTPIKRDFSSASSHPHPQQQQQQQSGQLNQTQNNNQTPQIEELIRQYKLPMKRAAKGTNGNNNVASDSSDKQTTETSPASSTKSFPDISMVTENLQNKQNFFENFEPTQLFPTFSIPPTRAQSPTPHFEDDGIGSNVYNSMNSTMMLKSDKQQKSQPSTEQQQQSQQLQQQQQPTHNGNSNQLVAGESHKAEHDILDPNTPAFQTNFIDSSFNYLNLQSGMTMDDDIHSLFNMMNQ

SEQ ID NO: 183 - DNA, 3069 bp, Candida tropicalis
atgtcggatcaaaaagacggggtagctaaactagaccaacagaaggagactgaaaattcacaccctgaaactcaaactgcaacaacaacgacaacaacaacagccacacagacaacatcaacaacttcaaataagaaaccaaaatcagatgcaaaggataaaccaaaagctttcactataaaatataaacgtcctagaggttcacgtgcttgtaccgtttgtcgttcaagaaaagtacgttgtgatgcagaaatccatattccttgtacaaattgcattacttttggttgtgaatgtattttaccagaagcaaagaaaagaggcaatcaatccggtgaatcaaaggcaaaacgacagaaagtaaatcaatcaaaggataaaccactttcggcaactgccttaaaaaagaaatcctcatctaattctacaataaacacaccaataaatgaaaatggcaattcactagagaaatcaacctctcctgtatcgaacaacaaatcttcagacatggcgacaacaatgtcatcaaataatgatacatctgaaaattcaaatactacgtccacggcggaaccaataattaatatatcacaagttagtgtacccccttcattgacatcgacatataaaaacagaccttctatgcataaaaaggaactacttgattcaaaagccaaaactgcattaacatttttgggtctgtcatcaattggtgttgttcctcaacgtgcaggtgaaaatcatgttgaattaactaccgatgtatttgatacaagtgatactaaattggattctgttgaattagaaattttaaaaatgagaggtgcattcttattaccaagcaaagaattatccctagaattgattaatgcttattttgagcatgttcatccattgatgccagttattaaccgatcgttatttatgaagaaatttaatgatcccaatgataatccaagtttaatggttcttcatgccgtgttgttgttgggatgtagggcatctaaaaatccattgttgttggattccaaaggtaccaacgatttagccagtataacatttttccgaagagcaaaagcgttatatgaaacaaattatgaaagtgatccggtatcaattattcagactgtaattttaattggttcctattgggatggtcctgaggatgtcaccaagaattctttttactggactagagttgctgtgggattagctcaagggtttggttttcaacgtgatgttagtaaatcacatcaattgactatttcagaaaagaaaatatggagaagaatttggtggtgtttatttgaaaaggatcgtaatgtagctatagcatttggaagaccagttgttattgatttaaatgattgtgatgtaccaatgttaaccgtggaagattttgatgaaactgatccagaattgggaatagttgacccatatcctattaatgaaacccaagccttgtattttattcatttagttaaattggcagaaataactggtattattatcaaacatcaatatagcgtaaaatctgaaaccatgaagagaagaaatgcattttccattattgaacattgtgatatgttgatgggtatttggtttacaaacttaccctcaaaattggtattttcattggcagataccctgactcataatttttatgcctgcttattaaatgcacaatattataatcgtttatatttgattcatagatcaaatttgattagaatggctagatcatcatcaacaaacccaaacaattataaatatccaagttggggtatttctttccaatcagcaagaatgatttctataatttcaaaaatattattggatagaaatttgattcaatatgttccagtcatgtacgtttacattgcatttagtgcattggttatgttgatttatcatgtggactcggataattcagttattgctgccactgcagctgattcgttatatgtttcaagagcagtattgaaagagcttctgaaatattggccagttgcaggcgtgttgttgaaattgtttgataaatatgctaacgataaattgaagagaacaagattaattgaaaatggtaatatgattgttgaatacaaggagaatgcagctaaagaaaagatgaaacaatctattggtgaatacgatagtcatagcagttccgctaccatgtcgattccaaatagacaacaacaacaacaacaggcatcaccattgccacagaatcgtcagtcacaacaacctttaccgttaccacagaccgcaaagagtaaagatcatacaatgttttcgccaacgtcagcaacttctggaatatcgccaggtggaggtgtttacaatggttatccagatcaaacaccaattaagagagatttttcactggcttcatcacacccacacccacaacaacaacaacaacagcaatcaggtcaattaaatcaaactcaaaataataaccaaacaccacagattgaagaattaataagacaatataaattaccaatgaagcgtgctgcaaaaggtactaatgggaataacaatgttgctagtgatagtagtgataaacaaactactgaaacatctcctgcttcatctacaaaatcatttccagatatatccatggttactgaaaatttacaaaataaacagaatttctttgaaaatttcgaaccaacacaattatttcctacattcagtattccaccaacaagagcacaatccccaacaccacattttgaagatgatggtattggtagtaatgtttataattcaatgaattcaaccatgatgcttaaatcagacaaacaacagaaaagtcaaccatccacagaacagcaacagcaactgcagcaacttcagcagcaacaacaaccaactcataatgggaattctaatcaacttgttgcaggggaatcacataaagccgaacatgacattcttgatccaaatacaccagcatttcaaactaatttcattgatagttcatttaattatttgaatttacaatcaggaatgactatggatgatgatattcattctttatttaatatgatgaatcaatag

SEQ ID NO: 184 - protein, 916 aa, Yarrowia lipolytica
MSSKVKEEEGATPGGSGNAKFGYRRAKPRASRACEVCHARKVRCDVTERMPCTNCQAFGCECKIPEVKRKKNDKKAAAEKVADKGTKDRKRRKTDGGEESDEGSVPPQAPSNASSSTASSPNTAPTAQQRLMHFQQETKQQQYQQHEGETKPDANPNLSDSSNTWLKMLDSKVVKQSGRVAFLGSSSNLNLLLDANPDNEAYHYPLPAEITGGNPVFHELDPEEIEILKLRGAFLLPPRELCDDIVESYFEKIHPVIPIVNRTQFMRRYNDPVNTPSLLLLQAVLLAGSRVCRNPALLDANGSSDQASLTFYKRAKALYDSNYENDRISIVQSLALMGWWWEGPEDVTKNVFYWSRVGLCVAQGFGLHRSVENSSLSVAEKRMWKRVWWVIFFRDRAIAVSLGRPVMINLEDSDVPMLTEDDFIEDEPDYPSPYPVNRLHSLYFIHAVKLSEIMGLVLRQQFSVGAEHSHRLNRIPVVSHCDMAMGSWMNNLPPELKYSVKDMGSHNFYKALLHSQYYTILCLVHRSNILQRRTSEANESAYPSWGIAFQAAHMIAKIMENMLAYNELRDTPAFMVYTLFSAMIMLVYQTESKSPSVVESANRSLDVCMKALEECGKTWVVARMVLKLFKHMNESQPIRNHMAKTIRRHARGVSKPDAAKQQQMPQAQHQASQPPHGAQQHHAQQQRHAQQQQQQQQHARQQQQQQQQQQQQHTQQQQQTHQPQPERKFNNHAFDQQQQSQQEGEEYLGDRQPPTNPGTPFNGTLPSKPGTPHPDFYFVTNTPPASNTFFESFQPMQLFPDVTGDMSNLQSQLQEPATSALPPDMFAHADGASHTEGGTYKSSPEDEPTAASGFGYAPQSLNIGDWYQYLMMNGEGGAAAGAAAGTAAGAPGSVPPGAPAEAHPEAATSNSWNESH

SEQ ID NO: 185 - DNA, 2921 bp, Yarrowia lipolytica
atgtcttccaaggtcaaagaggaggagggcgccaccccgggcggctcaggcaacgccaaatttggctatcgaagggccaagccgcgagcttccagggcttgtgaggtgtgagtgagagaggagggaagattgtcagacggacggataggtggagctgatcgcgacgaaccactcagtactaacacagatgccatgcccgaaaagtccgatgtgacgttacagaacgaatgccgtgtaccgtgagtatggtggggtggaagaaacaaacactccaggaacaaaagcgttgtcgacgtgtgagtgacatgaggccatatcaactaacatagaattgtcaagcatttggatgcgagtgcaagatacccgaagtgaagcggaaaaagaacgacaaaaaggcggcggcagaaaaggtggcggacaagggaaccaaggaccgcaaacgacgcaagacggacggcggcgaggagtccgacgagggctccgtgcccccccaggcgccctccaacgcgtcttcctccacagcgtcgtcgcccaacacggcccccactgcccagcagcggctcatgcactttcagcaggagaccaaacagcaacagtaccagcaacacgagggcgagacgaaaccggacgccaaccccaacctcagcgactcgtccaacacgtggctcaaaatgctcgactccaaggtggttaaacagagtggccgggtggcgtttctgggctcctcgtccaacctcaatctgttgttggacgctaacccggataatgaagcctaccactaccccttgccagccgaaatcacaggtggaaaccccgtgttccatgaactggatcccgaagagattgagattctcaaactgagaggagccttcctgttacctccccgagaactgtgtgacgacattgtggagagctattttgaaaagatccacccggtcatcccaattgtcaacagaacacagttcatgcgccgctacaacgaccccgtcaacacgccgtcgctgctgttgcttcaggccgttctgctggctggttctcgagtgtgcagaaacccggctctactggacgccaatgggtcgtcagaccaggcgtcgctcaccttctacaagcgagccaaggcactgtacgactccaactacgaaaatgatcgtatttcaattgtgcagtcgctggccctcatgggctggtggtgggagggtcccgaagacgtgaccaaaaacgtcttctactggtcgcgtgtgggtctgtgtgtggcgcaaggattcggtctgcatcgatctgtggaaaactcgtcgctgtcggtggccgaaaagcgaatgtggaagcgggtgtggtgggtcatctttttccgagaccgagccatcgccgtatctttggggcgacctgttatgatcaacctggaagactcggatgtgccaatgctcaccgaagacgatttcattgaggacgagcctgactacccgtctccctaccccgtcaacagactccactcgctctattttattcacgccgtcaagctgtctgaaatcatggggcttgttctgcgacaacaattcagtgtgggtgccgagcactcgcaccgactaaaccgaattcccgtcgtctcgcactgcgacatggccatgggctcgtggatgaacaacctgccgccggagctcaagtactccgtcaaggatatgggctctcacaacttctacaaggccctgctccactcacaatactacacgattctgtgtcttgtgcaccgaagcaacattctgcaacggcgaacgtcagaggctaacgagagcgcatacccttcgtggggtatcgcgttccaggccgctcacatgattgccaaaatcatggagaacatgttagcgtataacgagctgcgtgacaccccggcgttcatggtgtacacgctcttttcggccatgatcatgcttgtgtaccagaccgagtccaagtcgccgtcggtggttgagtctgccaaccggtcgctggacgtgtgtatgaaggccctggaggaatgcggcaagacgtgggtggtggcacgaatggtgctcaagcttttcaagcacatgaacgagtcgcagcccattcgaaatcacatggccaagaccatccgacgtcatgctagaggcgtcagcaaacccgacgcagcaaagcagcagcaaatgcctcaagctcagcaccaggcttcacaaccaccacatggcgcccaacagcaccatgcccaacagcaacgacatgcccagcaacaacaacaacagcagcagcatgctcgacagcaacagcagcagcagcagcaacaacaacagcaacacacacaacagcaacaacagacgcatcagccacagccagaacgcaagttcaacaatcatgcgtttgaccagcagcagcaatcgcagcaggaaggagaggagtacctgggcgatagacagcctcctacaaatcccggcacccctttcaacggcacgctgccatccaagcccggcaccccgcatccggacttttactttgtcactaacaccccgccggcttcgaacaccttctttgagtcgttccagcccatgcagcttttccccgacgtgactggcgatatgtctaacctgcagtcgcagctccaggagcccgccaccagcgcgcttcctccggacatgtttgcccacgccgacggagccagccacaccgaaggcggcacctacaagtcgtcgcccgaggacgagcccaccgcggccagtggatttggatacgcccctcaatcgctcaatattggcgactggtaccaatatctgatgatgaacggtgaagggggtgctgctgctggcgctgctgctggcactgctgcaggcgcccctggttctgttcctccaggtgctcctgctgaggctcatcctgaagctgccacttccaactcttggaatgagtctcactaa

SEQ ID NO: 186 - protein, 529 aa, Kluyveromyces lactis
MVEGHPLEKVLSASALTSSSNSSSRSSIPLTFEVTHQHKTQIKRFQNVLTSDSATQDDGNDDPSRNQGNEVSEQFHLLQYPEQHQHQHQNKHQHQHQQQHEKGDLDEVLCTQRMFRKLSTGSDDVKKVYSHAQLSSTAHGVRLLSKNLSNTKVALEVKKLMIVTKRQDDSLIYLTRELVEWILVNYPTIDVYVEYGFERNESFNAKELCKDSKCGSHKIQYWSPEFVKEHEDFFDLIITLGGDGTVLYVSSIFQKNVPPVMSFALGSLGFLTNFQFEDFKHALSKILQNKIKTKMRMRLCCQLFRKRIKKVDEEARKTHIKYTMEGEYHVLNELTIDRGPSPFISMLELYGDGSLLTVAQADGLIIASPTGSTAYSLSAGGSLVYPSVNAIAVTPICPHTLSFRPIILPDSMTLKVKVPKASRSTAWAAFDGKNRVEMKRGDYIVINASPYSFPTLEARSTEFIDSISRTLNWNVRESQKSFTHMLSRKNQQKYEIHTVRTRQDSEEEEELEDDQSDDYSTDSDSELNE

SEQ ID NO: 187 - DNA, 1590 bp, Kluyveromyces lactis
atggttgaaggacaccctttggagaaggttctgagtgctagtgcactaacttcaagcagtaacagctcatcaagaagtagtattcccttgacatttgaagtcactcatcaacacaagactcagatcaagcggttccagaatgtgttaactagtgatagtgccacccaagatgacggcaacgatgaccctagtagaaatcaagggaatgaggtgagtgaacaatttcatttgctgcagtatcctgagcagcatcaacatcaacatcaaaataaacatcaacatcaacatcagcagcagcacgaaaaaggagatctggacgaggtgctctgtacccaacggatgttcaggaaactatctactgggagcgatgatgtgaaaaaggtttattcgcatgcacagctatcgtccactgcacatggagtgagattattatccaaaaatctatccaacaccaaagtggcattagaagttaagaaattaatgatagtaactaaaaggcaagatgattctttgatctacttgacaagggagttggtagagtggatccttgtcaattatccaacgatagatgtttatgtggaatacggttttgaacgaaacgaatctttcaacgcaaaagagttgtgtaaagacagtaaatgtggttcgcataagattcaatattggtctccagaatttgtgaaagaacacgaagatttctttgacctaatcataacacttggtggagatggcacagtattatacgtatcatcaattttccaaaagaatgtgccaccggtcatgtcatttgccttggggtctctaggattcttgacgaacttccaatttgaagacttcaaacatgctttgtccaagattttacaaaacaagattaaaactaagatgagaatgcgactatgttgtcaacttttcaggaaaaggatcaagaaagtggacgaggaagcacgcaagacgcatattaagtacacaatggagggagagtaccatgttttgaatgaacttacgattgacagaggtcctagtccgttcatttcaatgttagaattatatggagatggatctttattaacagtggcacaagcagacggtctgatcatagcctcgcccactggatccacagcgtattccttaagtgctggtggttccttggtataccccagcgtcaacgctattgcagttacaccaatctgtcctcatactctaagtttcagacccatcatcttgccggatagtatgacgttaaaagtgaaagtcccaaaggctagcagaagcaccgcatgggcagcatttgacggtaagaacagagtggaaatgaagaggggcgactacatagtgataaacgcaagtccgtattcattccctacactcgaagcccgcagcacagaatttattgacagtatcagtagaacattgaattggaacgtcagggaatcccaaaagtcgttcacacatatgctctcaagaaagaatcaacagaagtacgaaatacacaccgtgagaaccaggcaggattctgaagaagaggaagaactcgaagacgaccaaagtgatgattattctactgactctgacagtgaactgaacgagtaa

SEQ ID NO: 188 - protein, 675 aa, Yarrowia lipolytica
MSTPVSESPYVHQRFDAALSAASALQELSAEDIQSSRLSHAHFVQTATGVRRIAKHLGKASVHIDVTKVMIITKARDNSLVYLTRDMARWLMDRGVVVYVDAKLEKSGRFDAPTLTANTPARMLRYWTAEMATQKPELFDLVITLGGDGTVLWASWLFQGTAPPVIPFALGSLGFLTNFEYHDFGKHLTKAMTQGVHVHLRMRFTCTVFKREMNPETGKRDKHHSKIGRHEVLNEIVVDRGPSPFISMLELYGDDNLLTIVQADGLILSTPTGSTAYSLSAGGSLVHPEIPAICVTPICPHTLSFRPMLLPDSMTLKVVVPRKNSRTSAWVSFDGRSRVELKSGDYITVRASKFPFPTVIRSDMDYIESVSRTLKWNTRELQKPLTSLSRPASTVSVNRSASLHASSSVPSGAGYSRLRSRSMKGTPGVMTPISQLTAALPTIQQSTPSVPNTTNSNTPTSTGTANSNINNNYNPTTNPTTNTNTNPTTTTTQKPYNLRDNQPSRSNSRDNGTASLPQSFSTSYMPNTMPSGMTSTNSATPQQYSAASTTCLNSPPVTRGFTPIQQQSPAQIQAFESMIDFDIDDEGTSTFADCSRRGGLVMSPTSVFSPTGSNDGMLTLDDLGKQVSDSDSDSYHSSEYEEEEYDIDIDLAHKTENLHVLDKDEDRNNEQEDTK

SEQ ID NO: 189 - DNA, 2028 bp, Yarrowia lipolytica
atgagcactccggtcagcgagtctccgtacgtgcaccagcggttcgacgctgctctcagcgccgcctcggccctccaggagctctcagctgaagacattcagagctcacgactcagccatgctcacttcgtccaaactgcgacaggagttcgacgaattgccaaacatctcggcaaggcctccgtccacatcgatgtgactaaggtcatgatcatcaccaaggcccgagacaactcgcttgtctacctgacccgagatatggcccggtggttgatggaccgaggagtggtggtctatgtggatgccaaactcgagaagagtggccgcttcgacgctcctacactgactgcaaacaccccagcacgtatgctcagatactggactgccgaaatggcgacccagaagcccgagctctttgatctagtcattaccctgggaggagacgggacggttctgtgggcctcgtggctttttcaaggcaccgctccccccgttattccctttgcgctgggttcgctcggcttcctgaccaattttgaataccatgactttggcaagcatcttacaaaggccatgactcagggagtacatgtgcatctgagaatgcgattcacatgcaccgtgttcaagcgggaaatgaacccggaaaccggaaagagagataagcatcactccaagattggccgacacgaagttctcaacgaaattgtcgtcgatagaggtccttcaccattcatctcaatgctggagctctatggggatgataacctgttgaccatcgtacaggctgatggcctcattctatcgactcccacaggatccacggcatactctttgtcagcaggaggctctctggttcaccctgagattccagccatctgtgtgactccaatttgtccccataccctgtccttcagacccatgcttctgcctgattcaatgacactcaaggtggttgttcctcgaaagaactcacggacttcagcatgggtctcatttgatggcagatcacgtgtggagctcaagtcgggcgactacatcacagtgcgagcttcaaagtttccattccccaccgtgatccgatcagacatggactacattgagtctgtgagtcgaacactcaagtggaacacccgagaactccagaagcctctgacgtcactttccagacctgcatcgaccgtttctgtcaacagaagcgcctctctccatgcctcttcgtcagtgccaagtggagcagggtacagccgtctgagaagtagatcgatgaagggcaccccaggagtcatgactcccatcagtcagcttactgcagcactgccaaccatccagcagagcactccttccgttcccaacacaactaatagtaacacacctacaagcacgggtactgccaactccaacatcaacaacaattacaacccaaccacaaacccaaccacaaacacgaacacaaacccgacgacgaccactacacagaaaccctacaatctcagagacaaccagcccagcagaagcaacagcagagataacggaactgcttctcttcctcaaagtttcagcacaagttatatgcccaacacaatgcccagcggaatgactagcactaactctgccactccccagcagtactcggcagcctctactacatgtctcaactcaccccctgttacccgaggcttcacacccattcagcagcagtcgccggctcagatccaggcgtttgagagtatgattgactttgatatcgacgacgaaggcacctccacctttgccgactgctctcgaagaggaggactggtcatgtccccgacatctgtcttctctcccaccggctccaacgacggcatgctgaccttggacgatctgggtaagcaggtgtcggactcggactcggactcgtaccactcttcggagtacgaggaagaggagtatgatattgacattgaccttgcccacaagacggagaatttgcatgtgctggacaaggacgaagataggaacaacgagcaggaggacacgaagtaa

SEQ ID NO: 190 - protein, 537 aa, Candida tropicalis
MYATEEKKIEISDLRFLLQQAIEYSTAMNNNNNNNSSSSNSNYHRAQFTTGSSTTTNSSTSSLSELTTSSSFQRKNNFVPHSPKIHSKLICDDVKAASGGNTPRSIKSHTELAETANGVRLLAKNLARATIQLDVKAIMVITKARDNSLITLTKQLVEWLLESHPHIVVFVDSKLQQSKRFGVAPCNSLKFWTKRLVKKQPELFDLVVTLGGDGTVLYASTLFQHIAPPVLPFSLGSLGFLTNFQFQDFKRILNRCIESGVKANLRMRFTCRVHSSDGKLIGQYQTLNELVVDRGPSPYVTQLELYGDGSLLTVAQADGLIIATPTGSTAYSLSAGGSLVHPGVSAISVTPICPHTLSFRPVLLPDGMFLKVKVPDGSRATAWCSFDGKDRTELKKGDYVTIQASSFPFPTVIASPTEYFDSVSRNLHWNVREQQKPLGNQTKDIDGDMDNLHISSEQDEESEPDITEDDEEDDEFDINFTDTERSSYSSTPSSDDIHYLSTNGAETPQSMSYLNNVDERCCFAHPNARVHLSGGKS

SEQ ID NO: 191 - DNA, 1614 bp, Candida tropicalis
atgtatgcaactgaagaaaaaaaaattgaaatctccgacctacggtttcttttacaacaagctattgaatactccacagcaatgaataacaacaacaacaataatagtagtagtagtaatagtaattatcatagagcacagtttactactggttctagtactactacaaattcatcaacttcatcattatctgaacttacaacttcatcttcttttcaacgcaagaataattttgtcccccactctccaaaaatccattccaagttgatttgtgatgatgttaaagctgctctgggtgggaatacacctcgttctattaaatcacatactgaattggcagaaacagctaatggtgttagattacttgccaaaaacttagctagagctactattcaacttgatgtcaaagcaatcatggttattactaaagcaagagataatagtttaatcacattaaccaaacaattagttgaatggcttttggaaagtcatccacatattgttgtctttgttgattcaaagttgcaacaatcaaaaagatttggtgttgcaccatgtaactcattaaaattttggactaaaagattggttaaaaaacaacctgaattatttgatttggttgttacattaggtggtgatggtactgttttgtatgcttctacattattccaacatattgctcctccagttttaccatttagtcttgggtctcttggttttttgacaaatttccaattccaagatttcaaacgtattttgaatcgttgtattgaatcaggtgtcaaagcaaatcttcgtatgcgtttcacttgtagagttcattccagtgatggcaaattaattgggcaatatcaaacattgaatgagttggttgtcgatagaggtccttctccttatgttactcaattagaattgtatggtgatggttctttgttgactgttgctcaagctgatgggttaattattgctactcctactggttcaactgcttattcattatcagctggtggttcattggttcatccaggtgttagtgctatcagtgttactccaatttgtccacatactttatcatttagaccagttttgttacctgatggtatgtttttaaaagtcaaagttccagatggtagtagagcaactgcttggtgttcatttgatggtaaagatagaactgagttgaaaaaaggtgattatgtcaccattcaagcttcatcattcccattcccaacagtgatagcatcaccaactgaatattttgactctgttagtagaaacttgcactggaatgtcagagaacaacagaaaccattaggaaatcaaactaaagatattgatggggatatggataacttgcatatttcaagtgaacaggatgaagaaagtgaaccggacattactgaagatgatgaagaagatgatgaatttgatattaatttcacagacacagaacgttcttcatatagttcaactccatctagtgatgatattcattatctttctacaaatggggcagaaaccccacaatccatgtcttatcttaacaatgttgatgaaagatgttgttttgctcatcctaatgctagagtgcatttaagtggaggtaagagctga

SEQ ID NO: 192 - DNA, 600 bp, Artificial Sequence
  Description of Artificial Sequence: Synthetic polynucleotide
ttttctttcgttctcgttccgtccttcaacccatatggatcgtgcgggaaaaatctgttttgcagcatgggccagtcgcatggaatccgatagaaagttagcaatcttgagattttatttctttagctgtttcggccccttttgtgtacccacgattttttttttttcaactttcttggttccatctcgtttgtcaacctcaattgaatggtcaattgaagcttgttcatgtctgtagaagctcaattgggtacaccatgtagtcacgatacctcgtcgcccagttgttctgccccttgcgcgaatgttccagcaggttctagcaagctctcattggggcattccagcaccttcgatggtgttctatgagcttcgatcgaaaaacacaaacctatatgcaggacttttgcagctcctccccataaaactaaaatcaacctcccccttaagtttgctgtttcctcatgcctataaatatacgccaacctagcccgacttccagacttttttttctaatccctttctttttgttttccttctaaatcaatcaattagatttattagactactatatcataataatcatcacataaaataacc

SEQ ID NO: 193 - DNA, 500 bp, Artificial Sequence; identical to SEQ ID NO: 167
  Description of Artificial Sequence: Synthetic polynucleotide

SEQ ID NO: 194 - DNA, 200 bp, Artificial Sequence
  Description of Artificial Sequence: Synthetic polynucleotide
tggaaatcgaactcgacggtcacaacacgctcccattaaccaagtacgaagacaacaagatactcggaaggattgtcatcagaagagaaggggtgactatcggggctggtacggttgtcgattattcagaagattgatatatagtctattaacaacatcaatataccaagtacgatgcatagagtaaccaacatgttggc

SEQ ID NO: 195 - DNA, 3039 bp, Artificial Sequence
  Description of Artificial Sequence: Synthetic polynucleotide
atgtcaagctcagatgaaggagatcacactcctgagttacaacaagagaaggttacccaaaatacccactcggacgcaccttctgcaacaccacaaacaaccccggctcagacaacaaccacaaccacaaccaccacttcctcctcccagacaaccactactaagaaaccaaaatcagatacaaaagataaaccaaaagctttcaccattaaatataaacgtcctagaggttcaagagcttgtaccgtctgtcgctcaagaaaagtccgttgtgacgcagaaatccacattccttgcacaaactgtataacatttggctgtgaatgcatcttgcccgaagcaaaaaagagaggcaatcaatcaggcgaatccaaagccaaacgacaaaagactcaaccaaaagacaaagcagcaacaacagctgcttctaccaaaaagaaagcaacaactacaactacaaccgaaaacggcgatgaggatggctccccactagaacagacatcgtcgtctcgcagtgctaaatccccggacttggtaacccctaccaaagaatcagaaacatccagtcacacatcatccacagcggagccaataataaatatatcacaagtgagtgttcctccgtctttaacctcaacttataaaaacagaccatcaatgcacaaaaaggaacttctcgactcgaaagccaaaacagcattgacattcttggggctgtcgtcaataggtgttgttcctcaacgtgtcggggagaaccacgtcgagttaaccactgacgtttttgacaccagtgatatcaagttggattctgtcgaattggagattttgaagatgagaggcgccttcttgttaccaagtaaagaactatcattggaattgatcaatgcgtattttgaacacgtccacccattgatgcccgttataaatagatccttgtttatgaagaaattcaacgatccaaacgacaacccaagtttaatggttctccacgccgtgctacttttgggctgtcgtgcctccaagaatccgttgttgttggactcgaatggaacaaacgatttagcaagcattacatttttcagaagagccaaagcgttgtacgagacaaactacgaaagtgaccccgtgtcaattatccaaaccttgattttgattggctcgtattgggatggtccggaggatgttaccaagaactccttctactggacaagagtggctgtggggttggcccaaggttttgggttccaacgtgatgtcagtaaatctcaccaattgacggtttctgaaaagaagatctggagaagaatctggtggtgtctatttgagaaagatcgtaatgtggctattgcattcggtagaccagttgtgattgatttaaatgattgtgatgtccccatgttgaccgtggatgattttgacgaaactgacccagagttgggcatcaccgatccataccctgtaaacgaaactcaagcattatatttcatacatttggtgaagttggcagaaatcacaggtatcattatcaaacatcaatacagcgtcaagtctgaaaccatgaagagaaggaacgcgttctccattatcgaacattgtgatatgttgatgggtatttggtttactaacttgccgtccaacttggtgttctcattggcggatagtctgacacacaacttctttgcttgtttgctaaatgcacaatattacaaccgtttgtacttgatccacaggtccaatttgatcagaatggctagatcgtcatcaaccaacccaaacaactacaagtacccaagttggggtatttctttccaatcggccagaatgatttccatcatttccaaaatcttgatggacaaggatttgatacaattcgttcctgtcatgtatgtttacatcgcgttcagtgcattggttatgttaatctaccatgtggactcggccaactcagtcattgctgctactgcttcagactccttgtttgtgtcaagagccgtcttgagggaacttcaaaaagcctggccagttgctgcggtgctattgaaattgtttgacaagtatgctaacgacaagttgaagagaaccaagcttattgagaacggtaacatgatcgtggagtacaaagagaatgctgctaaagaaaagatgaagaagtctattaatgaatatggcaccaacaccagtccaacagcaatgccaattccaaatagactgccattatcacaaccacagcaacaaccacagcaacaacaacaacaccgacaagttgttcaacagcaattgccgcttccgcagccggcaaaaccaagagaccgtacgttgttctcgccaagttctgtcacatcaggggtttctccgggtggtaatgtttacaacaactactcagagcagacaccggtcaaacaagagttttcgctggtttctcctgttgctgcaaacccacctcaacagcaagtacaaggtagcaaccctactccacagattgaagaattggttaaacaatacaagttgccaatgaaacgtgctgctaaggcgaacaatggaaacggtgatagcagtgataaacaaaccaccgatacttctccagcatcctccaccaagtcgttcccagatatctccatggttactgagaacttgcagaacaagcagaacttttttgaaaactttgaaccaacacagttgttccctactttcagcatcccaccaactagagcgcagtctccaacgccaaatttcgatgatggagctattggcagtaacgtgtacaataccatgaacaccaccatggagatcaaagaagaaaggacaccacagccacaacaatcgggggaaaatcagcaggaacaacctcacaatggtaatgctgctgcaagtcttgctgctccagcacaaacactcaaggacgaacacgacattcttgatctacatactccaggattccaaaccaactttattgatagctccttcaactacttgaacttgcaatcaggaatgaacatggacgaggacattcattctttgtttaacatgatgaaccaatag

SEQ ID NO: 196 - DNA, 769 bp, Artificial Sequence
  Description of Artificial Sequence: Synthetic polynucleotide
gaattcggccggccacaagtgcacgtactgtgacaaggcattccacagattggagcaccagacaagacacatacgaacccacacgggcgaaaaaccccatgcctgcacctttcctgggtgtgtcaagcgcttcagcaggtcagacgaactcacaagacacttgagaatccacaccaacccatcgtcaagaaagagaaagaacaagagtcaggacttgatgggaccaactcctatgagcatcaatggccagaacttgcctccaggctcgtatgccgtgacaaacacgggtatcccctttgctatcgaccgtaacgggccagaccggccggatccgcattcgggccagaccggccggatccgcattcgggccagaccggccggatccgcattcgggccagaccggccggatccgcattcgggccagaccggccggatccgcattcgggccagcacggccgcggccgcaataccgtctcagccatcatctacatccttaaacctagagttctacaaccagggtaacgcttcccacgcaagcaaaaaatcgcgaccaaactccccatgccagtccgccatgaacatctcgtccatcatgagctcaccaagcgaaaccccgctacagacgccatcacagtccccacgcttgcacgcaagcaacgggcctggtaatagcagtgtcattgagggtgcacaggcaaagttggagagtatagcgacgacaggaacacagttgccgccaattagatcggtgttgaggccggccgcatgc

SEQ ID NO: 197 - DNA, 2812 bp, Artificial Sequence
  Description of Artificial Sequence: Synthetic polynucleotide
  modified_base (1923)..(1923): a, c, t, g, unknown or other
gagctccaattgtaatatttcgggagaaatatcgttggggtaaaacaacagagagagagagggagagatggttctggtagaattataatctggttgttgcaaatgctactgatcgactctggcaatgtctgtagctcgctagttgtatgcaacttaggtgttatgcatacacacggttattcggttgaattgtggagtaaaaattgtctgagttgtgtcttagctactggctggccccccgcgaaagataatcaaaattacacttgtgaatttttgcacacacaccgattaacatttcccttttttgtccaccgatacacgcttgcctcttcttttttttctctgtgcttccccctcctgtgactttttccaccattgatataaaatcaactccatttccctaaaatctccccagattctaaaaacaacttcttctcttctgcttttcctttttttttgttatatttatttaccatcccttttttttgaatagttattccccactaacattgttcaaatcttcacgacataatgtcccatcaagttgaagaccacgacttagacgtgttctgtttattggccgatgccgtgctccatgaaattcctcccagcgaaatcgtggagtaccttcatcctgacttcccaaaagataagatcgaagagtatttgacaggcttttcccgtccgtctgctgttcctcagtttagacaatgtgccaagaagcttatcaacagaggctccgagctgtcgatcaagttgtttttgtacttgaccactgcgttggactcaagaatccttgcacctgccttgaccaattcgttgactttgatcagggatatggatctttcccaaagagaggagttgttgagatcatggagagactctcctttaactgcaaaaagaagattatttagagtgtatgcctcttttaccttgtctacttttaacaagttgggaactgacttgcactttaaggcgttgggctacccaggtagagagctcagaacgcaaattcaagactacgaagtcgacccttttagatattcgtttatggagaaacttaaacacgagggccacgaattgttccttcctgatattgacgttttaatcatcgggtcgggatcaggagcaggtgtggttgcacaaactcttactgaaagtggcctcaaatcattggttttggaaaagggcaaatactttgccagtgaagaattgtgcatgacggacttggacggtaacgaggcattattcgaaagtggaggaacaattccttccaccaaccaacaattgttcatgattgcaggttcgacttttggtggtggttctacagttaattggtctgcatgtttgaagaccccattcaaagtaagaaaggaatggtatgacgatttcggacttgattttgtcgctactcaacaatacgacgattgtatggattacgtgtggaagaaaatgggtgcttcgaccgaacatatcgaacattctgctgcaaatgccgtcatcatggacggggcagcaaaacttggctacgcacacagagcacttgagcagaataccgggggccatgttcacgactgtgggatgtgccacttgggatgtagattcggtatcaaacaaggtggtgtaaattgctggttccgtgaacctagtgaaaagggttctaagttcatggaacaagttgttgttgaaaagattttgcagcacaagggtaaagctactgggattttgtgtagagatactgaaagtgggattaaattcaaaatcactggaccaaagaaatacgttgtttccggtggttctttgcaaaccccagttttgttacaaaaatctggtttcaagaataaacatattggagctaacttaaaacttcacccagtctcggttgcccttggggactttggtaatgaagtggactttgaagcntacaagagaccacttatgaccgccgtttgtaatgccgtcgatgatttagatggcaaggcccatggaacaagaattgaagccattttgcatgctccatacgtcactgccccattttacccatggcaatcaggtgctcaagcaagaaagaacctcttgaaatataaacaaactgtgccgttattacttctttctagagatacatcatcaggtaccgttacatatgataaacaaaagcctgacgtattggtagttgactacactgttaacaagtttgacagaaattcgattttacaagggtttttggttgcttccgacatcttgtatattgaaggtgctaaagagattttgtcaccacaagcttgggtaccaaccttcaagagcaacaaaccaaaacatgctagatcgatcaaagacgaagattacgtcaaatggagagaaaccgtggccaagatcccatttgactcctacggttcgccatacggttctgctcatcaaatgagttcgtgtagaatgtctggtaagggaccaggatacggtgcttgtgacactaaaggaagattatttgaatgtaacaacgtttacgttgctgatgcttcggttatgcctactgcatcgggagtcaatcctatgatcactacaatggcttttgcaagacatgtggccttatgtcttgctaaagacttgcaaccacaaactaaactttaggaatagaagagagtgactcttttgataagagtcgcaaatttgatttcataagtatatattcattatgtaaagtagtaaatggaaaattcattaaaaaaaaagcaaatttccgttgtatgcatactccgaacacaaaactagccccggaaaaacccttagttgatagttgcgaatttaggtcgac

SEQ ID NO: 198 - DNA, 3596 bp, Artificial Sequence
  Description of Artificial Sequence: Synthetic polynucleotide
cggattatcttctgttttttttctttttttttttttttatagaaaaagcagtgagaaaatttttcctccagtatgtgggcaccaacaccaccacctgcacaaaagatgttcctcccccacttgatctttgtgggattctttgctttttttcggggagcagatatgtcagctggtggtgatccataggagctctcttgctcatgcttattaaaaaaaaagacagcaaagccttcgacgaggtccatggttcctaatcggagtgtcaagcacgacgaacattgcccaccagtaatattcctccaactctaagttaaaaaaaggccagtttttgttccctatccggagttgcacaaacggttgtacacatcgccaaactggataccacaggggcactacaatcttgtttcattgtttttgttgacccacgggtggtacttcgttgtatcgaatattttctggcacccatttttcttggggcgagatggagagagagacagagagagaccaccatgaggctgatgcaggtgcccaggttgaacaagatgaaattcgctcggactggggtttccgccccttccagaccgcttttctcagcacgatgatgtcgactgttgaaacgggggcgggcagggaagacagaaaacagaaattttcattaaattactgattgggttaattggcgggttagattctggagcttgaggaggaagaggaggagaaggagaaggaggaagcctaaaaagtttttccgaaaattggaccagtttaaggcatccgacatatattacacaaagcaaggtgagtgcatgggaatataataatgcgtggttttgtgtagtttgttcaagaaaagcgaacgagtgggcagaaattgcgggttacggtcgtttctttttcctgggtgtgcttttgtctttctggctgtaagaattgtcatataaatttaactccagatctctctttctctcccccggtcccgtaagacaaaaaaaaattgccctgtttccttctgcatcaccaaattcaccaccaccaccatgttaacccctaaggacaagaagaacaaggaggacagaccatacaagtgcacgtactgtgacaaggcattccacagattggagcaccagacaagacacatacgaacccacacgggcgaaaaaccccatgcctgcacctttcctgggtgtgtcaagcgcttcagcaggtcagacgaactcacaagacacttgagaatccacaccaacccatcgtcaagaaagagaaagaacaagagtcaggacttgatgggaccaactcctatgagcatcaatggccagaacttgcctccaggctcgtatgccgtgacaaacacgggtatcccctttgctatcgaccgtaacggcaatcacgtgtaccctcaaccataccctgtgtttttcgtcccacagccaaacggatacatgcagcctgttgttcaagcaccagggctctccattgttccaccaccaccaccacaacaacaacaacaacaaggacaagcaccacaacagcagcaacaacaactacattcacaacagcaacaacagcgtatgggtagcccacacagcaatatgacaacacctacacatttgcaacaggaaggatcagcagttttctccattccttcgtcccctacaaactcataccaaaatgtcccaaaccgtccaaatcaacaaccattaccacctccacaaccagttaccatgtccacaccaatgtctacgagatcaatgtcgtcagatgctattagattgccaccactaacgtcaaacaactccttccaacaacaacaacaacagcagccacgcccaccaccaaccattctcaaatcggagtctacaactagcctatactcggattcaaacagggtgtttagccaaccaaactcaaatttgcactctttgggtacgtcgccagacacaagcccatccgccatgccaccaccaacagttgtcccaactccgtctttcagcaacttgaatgaatacttccagcaaaagagcaacaacccaaggattttcaacgccagttcatcatccttgagctcgttgagtggcaagatcagatccacgtcatccacaaaccttgcaggattgcaaagattgactccattggttcagacatctacaaactcgacacccggaaaatccataataccgtctcagccatcatctacatccttaaacctagagttctacaaccagggtaacgcttcccacgcaagcaaaaaatcgcgaccaaactccccatgccagtccgccatgaacatctcgtccatcatgagctcaccaagcgaaaccccgctacagacgccatcacagtccccacgcttgcacgcaagcaacgggcctggtaatagcagtgtcattgagggtgcacaggcaaagttggagagtatagcgacgacaggaacacagttgccgccaattagatcggtgttgagctttacaaacttgtcggattatcctccgcctccttctaatagatagatatacataattattagtaagagttgataaaaatacatacaaaaaaaccaactaagggataccgttatacatattacttcagtttcgtaacaatcagacgagtgtatatctggctggctatgtaattaacgcgggatgggagcattgtttctctcccccgtgggcgaagtctgcttaacccccaggatctgcagcctgcaaacccagtgcaactccattgaacagagcctgcgaagcaaattttctcgaaacattttccagaccttggacttattccaccgagaaatgcaaccaacgaacaacgcaagtttcagtgtttcctttttgtattttgcaggtgcatacgcaagtgtgagtgaatgagtagtgtgatgggtttctgcttttgtggatttccaggttacgtcctggtattaattgttctttgggggttggtctcttttgggtagcttgttggtacaaggcgggttttttcattgcagcttcctttggattacaacgtgctttctccccacggaccgttgggcatggacggaaatataataacagccgggagaataatacggaaggtgacgaagataattatttcttcggattaaatttcccctggaggttcaagagtgaattattatcatccatcgtcatcgccatcacttcctcttcctcccccaacttcatctccagatcaatccccccacggatttttcacttctgattattttttaccacaaaacaataaccaggcttttctttcttttttttccatttttgaggagctgcccacaatggacccagtttacggccgcagaatcattcagtttcaaatacctggggaagacaagacaaagggaaggtgattagaacacatttgtgtgccgtacttgttcgccctacggggttgctcgcaacgactttctctccgccctgcgaaaaactcccgtgctccctccccagaatcttactccgatgtttagactttttctcaacaactataaagggatcacgaatcctcagacactcttgtcattgctttcctagaccattatcaacttaccaaacaacaaacatgtctactgctactgcttcccc

SEQ ID NO: 199 - DNA, 1605 bp, Candida sp.
atgtatgcgaccaacgaaaaaaaaattgaaatctccgacctacgatttcttttacaacaagcaatcgaatactccacagccatgaataacaacaataatcatagctacaacaccaataacaactcccaccgagctgtattcacctctagcagctcaaccaccaactcatcgacctcctccttgtctgagctcaccacgtcatcgtctttccaccgcaagaacaatatgatcccgcattctcccaaggtccactccaagttggtctgtgacgaaatctccgccgctctgactagtggaacaagcacgccgcgctccatcaagtctcacaccgagttggccgaaactgccaacggggtcagattgctcgccaagaacttgtcccgggccacgatccagctcgacgtgagagcaatcatggttatcaccaaggctagagacaacagcttgatcacattgaccaaacaactagtagagtggttgttggaaactcaccctcacatcaccatctttgtcgacgccaaattgcagcaatctaagcgtttcggcgtagctacttgcaactcgttgaagttctggaacaaaagattggttaaaaaacagccagagttgtttgacttggtcgtcacgttgggcggtgatggtaccgtgttgtatgcgtctactttgttccagagcattgcaccaccggtcttgccattcagtcttgggtccctaggtttcttgacaaatttccagttccaggatttcaagcgcattttgaaccgctgtatcgagtcaggtgttaaggcaaacctccgtatgcgtttcacctgtagggttcatgccaacgacggcaagttgattggacagtaccagactttgaatgagcttgttgttgatagaggtccttctccttacgtcaccctgttggaattgtacggtgacggctcgttgttgacggttgctcaagcagacgggttgattatcgctactccaactgggtcgactgcttattcgttgtctgctggaggttctttagtgcatcctggtgttagtgctattagtgtcaccccaatctgtccgcacaccctatcttttaggccaattttgttgcccgatggaatgtttttgaaagtcaaagttccagacggtagtagagctactgcctggtgttcgttcgatggtaaggacagaaccgaattgcacaagggtgattacgttaccatccaagcttcgccattcccattccctaccgtgatagcttctccaaacgaatactttgattctgtcagtagaaacttgcattggaacgtcagagaacaacagaagccattgagtgataactccaaggatgttgatggggccatggacaacttgcacatttcgagtgaacaagacgaagaggacgaggaacctgagattactgaagaggaggatgattttgatatcaatttcaccgatactgagcgttcttcctacagttctactccttcaagtgacgacatgaactttcttgcgggtaatggcacagctaccccacagaacatgtcttatcttaacaatgttgatgagagatgttgttttgcccaccctaatgctagagttcacttgagtggcggcaaaagc

SEQ ID NO: 200 - DNA, 1605 bp, Candida sp.; identical to SEQ ID NO: 199

SEQ ID NO: 201 - DNA, 600 bp, Artificial Sequence; identical to SEQ ID NO: 192
  Description of Artificial Sequence: Synthetic polynucleotide

SEQ ID NO: 202 - DNA, 500 bp, Artificial Sequence; identical to SEQ ID NO: 167
  Description of Artificial Sequence: Synthetic polynucleotide

SEQ ID NO: 203 - DNA, 200 bp, Artificial Sequence; identical to SEQ ID NO: 194
  Description of Artificial Sequence: Synthetic polynucleotide

SEQ ID NO: 204 - DNA, 3039 bp, Artificial Sequence; identical to SEQ ID NO: 195
  Description of Artificial Sequence: Synthetic polynucleotide

SEQ ID NO: 205 - protein, 9 aa, Artificial Sequence
  Description of Artificial Sequence: Synthetic peptide
DYKDDDDKG

SEQ ID NO: 206 - protein, 14 aa, Artificial Sequence
  Description of Artificial Sequence: Synthetic peptide
GKPIPNPLLGLDST

SEQ ID NO: 207 - protein, 10 aa, Artificial Sequence
  Description of Artificial Sequence: Synthetic peptide
EQKLISEEDL

SEQ ID NO: 208 - protein, 11 aa, Herpes simplex virus
QPELAPEDPED

SEQ ID NO: 209 - protein, 9 aa, Influenza A virus
YPYDVPDYA

SEQ ID NO: 210 - protein, 11 aa, Vesicular stomatitis virus
YTDIEMNRLGK

SEQ ID NO: 211 - protein, 6 aa, Artificial Sequence
  Description of Artificial Sequence: Synthetic 6xHis tag
HHHHHH

SEQ ID NO: 212 - protein, 7 aa, Artificial Sequence
  Description of Artificial Sequence: Synthetic peptide
  MOD_RES (3)..(5): Any amino acid
  MISC_FEATURE (3)..(5): This region may encompass 1-3 residues, wherein some positions may be absent
CCXXXCC

SEQ ID NO: 213 - protein, 6 aa, Artificial Sequence
  Description of Artificial Sequence: Synthetic peptide
CCPGCC

SEQ ID NO: 214 - protein, 6 aa, Artificial Sequence
  Description of Artificial Sequence: Synthetic peptide
LVPRGS

SEQ ID NO: 215 - protein, 5 aa, Artificial Sequence
  Description of Artificial Sequence: Synthetic peptide
DDDDK

SEQ ID NO: 216 - protein, 7 aa, Artificial Sequence
  Description of Artificial Sequence: Synthetic peptide
ENLYFQG

SEQ ID NO: 217 - protein, 8 aa, Artificial Sequence
  Description of Artificial Sequence: Synthetic peptide
LEVLFQGP

SEQ ID NO: 218 - DNA, 25 bp, Artificial Sequence
  Description of Artificial Sequence: Synthetic primer
aacgacaagattagattggttgaga

SEQ ID NO: 219 - DNA, 25 bp, Artificial Sequence
  Description of Artificial Sequence: Synthetic primer
gtcgagtttgaagtgtgtgtctaag

SEQ ID NO: 220 - DNA, 51 bp, Artificial Sequence
  Description of Artificial Sequence: Synthetic primer
agatctcatatggctccatttttgcccgaccaggtcgactacaaacacgtc

SEQ ID NO: 221 - DNA, 59 bp, Artificial Sequence
  Description of Artificial Sequence: Synthetic primer
atctggatcctcattactacaacttggctttggtcttcaaggagtctgccaaacctaac

SEQ ID NO: 222 - DNA, 38 bp, Artificial Sequence
  Description of Artificial Sequence: Synthetic primer
acatctggatcctcattactacaacttggccttggtct

SEQ ID NO: 223 - DNA, 47 bp, Artificial Sequence
  Description of Artificial Sequence: Synthetic primer
cacacagctcttctagaatggctccatttttgcccgaccaggtcgac

SEQ ID NO: 224 - DNA, 50 bp, Artificial Sequence
  Description of Artificial Sequence: Synthetic primer
cacacagctcttcctttctacaacttggctttggtcttcaaggagtctgc

SEQ ID NO: 225 - DNA, 21 bp, Artificial Sequence
  Description of Artificial Sequence: Synthetic primer
gtctactgattcccctttgtc

SEQ ID NO: 226 - DNA, 20 bp, Artificial Sequence
  Description of Artificial Sequence: Synthetic primer
ttctcgttgtacccgtcgca

SEQ ID NO: 227 - DNA, 32 bp, Artificial Sequence
  Description of Artificial Sequence: Synthetic primer
cacacacatatgcgacgggtacaacgagaatt

SEQ ID NO: 228 - DNA, 32 bp, Artificial Sequence
  Description of Artificial Sequence: Synthetic primer
cacacaacgcgtagacgaagccgttcttcaag

SEQ ID NO: 229 - DNA, 21 bp, Artificial Sequence
  Description of Artificial Sequence: Synthetic primer
atgatctgccatgccgaactc

SEQ ID NO: 230 - DNA, 28 bp, Artificial Sequence
  Description of Artificial Sequence: Synthetic primer
agcgagttcggcatggcagatcatcatg

SEQ ID NO: 231 - DNA, 32 bp, Artificial Sequence
  Description of Artificial Sequence: Synthetic primer
cacacactgcagttgtccaatgtaataatttt

SEQ ID NO: 232 - DNA, 56 bp, Artificial Sequence
  Description of Artificial Sequence: Synthetic primer
cacacatctagacccgggctcttcttctgaataggcaattgataaacttacttatc

SEQ ID NO: 233 - DNA, 48 bp, Artificial Sequence
  Description of Artificial Sequence: Synthetic primer
gagcccgggtctagatgtgtgctcttccaaagtacggtgttgttgaca

SEQ ID NO: 234 - DNA, 37 bp, Artificial Sequence
  Description of Artificial Sequence: Synthetic primer
cacacacatatgaattctgtactggtagagctaaatt

SEQ ID NO: 235 - DNA, 24 bp, Artificial Sequence
  Description of Artificial Sequence: Synthetic primer
gagctccaattgtaatatttcggg

SEQ ID NO: 236 - DNA, 25 bp, Artificial Sequence
  Description of Artificial Sequence: Synthetic primer
gtcgacctaaattcgcaactatcaa

SEQ ID NO: 237 - DNA, 53 bp, Artificial Sequence
  Description of Artificial Sequence: Synthetic primer
gaattcacatggctaatttggcctcggttccacaacgcactcagcattaaaaa

SEQ ID NO: 238 - DNA, 40 bp, Artificial Sequence
  Description of Artificial Sequence: Synthetic primer
gagctcccctgcaaacagggaaacacttgtcatctgattt

SEQ ID NO: 239 - DNA, 37 bp, Artificial Sequence
  Description of Artificial Sequence: Synthetic primer
cacacacccgggatgatcagaaccgtccgttatcaat

SEQ ID NO: 240 - DNA, 62 bp, Artificial Sequence
  Description of Artificial Sequence: Synthetic primer
cacacatctagactctcttctattcttaattgccgcttccactaaacggcaaagtctccacg

SEQ ID NO: 241 - DNA, 25 bp, Artificial Sequence
  Description of Artificial Sequence: Synthetic primer
gatattattccaccttcccttcatt

SEQ ID NO: 242 - DNA, 26 bp, Artificial Sequence
  Description of Artificial Sequence: Synthetic primer
ccgttaaacaaaaatcagtctgtaaa

SEQ ID NO: 243 - DNA, 32 bp, Artificial Sequence
  Description of Artificial Sequence: Synthetic primer
atgtccgacgacgagatagcaggaatagtcat

SEQ ID NO: 244 - DNA, 33 bp, Artificial Sequence
  Description of Artificial Sequence: Synthetic primer
tcagaagagtaaatacaacgcactaaccaagct

SEQ ID NO: 245 - DNA, 30 bp, Artificial Sequence
  Description of Artificial Sequence: Synthetic primer
atgctgaagagaaagagacaactcgacaag

SEQ ID NO: 246 - DNA, 30 bp, Artificial Sequence
  Description of Artificial Sequence: Synthetic primer
gtggttatcggactctacataatgtcaacg

SEQ ID NO: 247 - DNA, 45 bp, Artificial Sequence
  Description of Artificial Sequence: Synthetic primer
atgactcaggactataaagacgatagtcctacgtccactgagttg

SEQ ID NO: 248 - DNA, 42 bp, Artificial Sequence
  Description of Artificial Sequence: Synthetic primer
ctattctacaatgtttaattcaacatcaccgtagccaaacct

SEQ ID NO: 249 - DNA, 26 bp, Artificial Sequence
  Description of Artificial Sequence: Synthetic primer
atgtcgtctttaaagaacagaaaatc

SEQ ID NO: 250 - DNA, 28 bp, Artificial Sequence
  Description of Artificial Sequence: Synthetic primer
ttataaatttatggcctctactatttct

SEQ ID NO: 251 - DNA, 30 bp, Artificial Sequence
  Description of Artificial Sequence: Synthetic primer
cctacttccacagctttaatctactatcat

SEQ ID NO: 252 - DNA, 27 bp, Artificial Sequence
  Description of Artificial Sequence: Synthetic primer
tttaagaaaacaactaagagaagccac

SEQ ID NO: 253 - DNA, 53 bp, Artificial Sequence; identical to SEQ ID NO: 237
  Description of Artificial Sequence: Synthetic primer

SEQ ID NO: 254 - DNA, 40 bp, Artificial Sequence; identical to SEQ ID NO: 238
  Description of Artificial Sequence: Synthetic primer

SEQ ID NO: 255 - DNA, 36 bp, Artificial Sequence
  Description of Artificial Sequence: Synthetic primer
cacacagctcttccataatgtcgtcttctccatcgt

SEQ ID NO: 256 - DNA, 45 bp, Artificial Sequence
  Description of Artificial Sequence: Synthetic primer
cacacagctcttccctctcttctattcttagtacattctaacatc

SEQ ID NO: 257 - DNA, 36 bp, Artificial Sequence; identical to SEQ ID NO: 255
  Description of Artificial Sequence: Synthetic primer

SEQ ID NO: 258 - DNA, 45 bp, Artificial Sequence
  Description of Artificial Sequence: Synthetic primer
cacacagctcttccctctcttctattcttagaacattctaacgtc

SEQ ID NO: 259 - DNA, 39 bp, Artificial Sequence
  Description of Artificial Sequence: Synthetic primer
cacacagctcttccataatggccacacaagaaatcatcg

SEQ ID NO: 260 - DNA, 52 bp, Artificial Sequence
  Description of Artificial Sequence: Synthetic primer
cacacagctcttccctctcttctattcttacatcttgacaaagacaccatcg

SEQ ID NO: 261 - DNA, 38 bp, Artificial Sequence
  Description of Artificial Sequence: Synthetic primer
cacacacccgggatgactgtacacgatattatcgccac

SEQ ID NO: 262 - DNA, 37 bp, Artificial Sequence
  Description of Artificial Sequence: Synthetic primer
cacacacccgggctaatacatctcaatattggcaccg

SEQ ID NO: 263 - DNA, 41 bp, Artificial Sequence
  Description of Artificial Sequence: Synthetic primer
cacacagctcttccataatgactgcacaggatattatcgcc

SEQ ID NO: 264 - DNA, 52 bp, Artificial Sequence
  Description of Artificial Sequence: Synthetic primer
cacacagctcttccctctcttctattcctaatacatctcaatgttggcaccg

SEQ ID NO: 265 - DNA, 39 bp, Artificial Sequence
  Description of Artificial Sequence: Synthetic primer
cacacacccgggatgattgaacaactcctagaatattgg

SEQ ID NO: 266 - DNA, 36 bp, Artificial Sequence
  Description of Artificial Sequence: Synthetic primer
cacacacccgggctagtcaaacttgacaatagcacc

SEQ ID NO: 267 - DNA, 44 bp, Artificial Sequence
  Description of Artificial Sequence: Synthetic primer
cacacagctcttccataatgattgaacaaatcctagaatattgg

SEQ ID NO: 268 - DNA, 51 bp, Artificial Sequence
  Description of Artificial Sequence: Synthetic primer
cacacagctcttccctctcttctattcctagtcaaacttgacaatagcacc

SEQ ID NO: 269 - DNA, 43 bp, Artificial Sequence
  Description of Artificial Sequence: Synthetic primer
cacacagctcttccataatgctcgatcagatcttacattactg

SEQ ID NO: 270 - DNA, 52 bp, Artificial Sequence
  Description of Artificial Sequence: Synthetic primer
cacacagctcttccctctcttctattcctatgacatcttgacgtgtgcaccg

SEQ ID NO: 271 - DNA, 43 bp, Artificial Sequence
  Description of Artificial Sequence: Synthetic primer
cacacagctcttccataatgctcgaccagatcttccattactg

SEQ ID NO: 272 - DNA, 52 bp, Artificial Sequence
  Description of Artificial Sequence: Synthetic primer
cacacagctcttccctctcttctattcctattgcatcttgacgtatgccccg

SEQ ID NO: 273 - DNA, 43 bp, Artificial Sequence
  Description of Artificial Sequence: Synthetic primer
cacacagctcttccataatggctatatctagtttgctatcgtg

SEQ ID NO: 274 - DNA, 53 bp, Artificial Sequence
  Description of Artificial Sequence: Synthetic primer
cacacagctcttccctctcttctattctcaagttctagttcggatgtacaccc

SEQ ID NO: 275 - DNA, 37 bp, Artificial Sequence
  Description of Artificial Sequence: Synthetic primer
cacacagctcttccataatggctttagacaagttaga

SEQ ID NO: 276 - DNA, 45 bp, Artificial Sequence
  Description of Artificial Sequence: Synthetic primer
cacacagctcttccctctcttctattcctaccaaacatcttcttg

SEQ ID NO: 277 - DNA, 47 bp, Artificial Sequence
  Description of Artificial Sequence: Synthetic primer
cacacagctcttccataatgtcttatgattcattcggtgactacgtc

SEQ ID NO: 278 - DNA, 56 bp, Artificial Sequence
  Description of Artificial Sequence: Synthetic primer
cacacagctcttccctctcttctattcttagatcttacctttgacatcggtgtttg

SEQ ID NO: 279 - DNA, 25 bp, Artificial Sequence
  Description of Artificial Sequence: Synthetic primer
gatattattccaccttcccttcatt

SEQ ID NO: 280 - DNA, 26 bp, Artificial Sequence
  Description of Artificial Sequence: Synthetic primer
ccgttaaacaaaaatcagtctgtaaa

SEQ ID NO: 281 - DNA, 36 bp, Artificial Sequence
  Description of Artificial Sequence: Synthetic primer
cacacagctcttccataatgggcgaaattcagaaaa

SEQ ID NO: 282 - DNA, 45 bp, Artificial Sequence
  Description of Artificial Sequence: Synthetic primer
cacacagctcttccctctcttctattcctagtagcccaagttttt

SEQ ID NO: 283 - DNA, 24 bp, Artificial Sequence
  Description of Artificial Sequence: Synthetic primer
tgccatccttggtagtcagttatt

SEQ ID NO: 284 - DNA, 45 bp, Artificial Sequence
  Description of Artificial Sequence: Synthetic primer
ccgaaacaaccgtagatacctttaatggcttgtccttggtgttga

SEQ ID NO: 285 - DNA, 45 bp, Artificial Sequence
  Description of Artificial Sequence: Synthetic primer
tcaacaccaaggacaagccattaaaggtatctacggttgtttcgg

SEQ ID NO: 286 - DNA, 22 bp, Artificial Sequence
  Description of Artificial Sequence: Synthetic primer
tgtcgccattcaaccagtagat

SEQ ID NO: 287 - DNA, 43 bp, Artificial Sequence
  Description of Artificial Sequence: Synthetic primer
tcctcgtccatcttcaacaagtcggtaccgagctctgcgaatt

SEQ ID NO: 288 - DNA, 43 bp, Artificial Sequence
  Description of Artificial Sequence: Synthetic primer
aattcgcagagctcggtaccgacttgttgaagatggacgagga

SEQ ID NO: 289 - DNA, 26 bp, Artificial Sequence
  Description of Artificial Sequence: Synthetic primer
ttgatccactgtcttaagattgtcaa

SEQ ID NO: 290 - DNA, 47 bp, Artificial Sequence
  Description of Artificial Sequence: Synthetic primer
ccgaaacaaccgtagatacctttaaccagaacgaagtagcggagaat

SEQ ID NO: 291 - DNA, 47 bp, Artificial Sequence
  Description of Artificial Sequence: Synthetic primer
attctccgctacttcgttctggttaaaggtatctacggttgtttcgg

SEQ ID NO: 292 - DNA, 41 bp, Artificial Sequence
  Description of Artificial Sequence: Synthetic primer
cgacagacctcaccgacgtatggtaccgagctctgcgaatt

SEQ ID NO: 293 - DNA, 41 bp, Artificial Sequence
  Description of Artificial Sequence: Synthetic primer
aattcgcagagctcggtaccatacgtcggtgaggtctgtcg

SEQ ID NO: 294 - DNA, 20 bp, Artificial Sequence
  Description of Artificial Sequence: Synthetic primer
aggattttgctgttggtggc

SEQ ID NO: 295 - DNA, 37 bp, Artificial Sequence
  Description of Artificial Sequence: Synthetic primer
cacacagctcttccataatggtcgccgattctttagt

SEQ ID NO: 296 - DNA, 47 bp, Artificial Sequence
  Description of Artificial Sequence: Synthetic primer
cacacagctcttccctctcttctattcttaagtggccttccacaagt

SEQ ID NO: 297 - DNA, 22 bp, Artificial Sequence
  Description of Artificial Sequence: Synthetic primer
accaagttcaacccaaaggagt

SEQ ID NO: 298 - DNA, 45 bp, Artificial Sequence
  Description of Artificial Sequence: Synthetic primer
ccgaaacaaccgtagatacctttaatcttcgtcaaaagtggcggt

SEQ ID NO: 299 - DNA, 45 bp, Artificial Sequence
  Description of Artificial Sequence: Synthetic primer
accgccacttttgacgaagattaaaggtatctacggttgtttcgg

SEQ ID NO: 300 - DNA, 43 bp, Artificial Sequence
  Description of Artificial Sequence: Synthetic primer
aatgtcgaaacccttgtcttcagggtaccgagctctgcgaatt

SEQ ID NO: 301 - DNA, 43 bp, Artificial Sequence
  Description of Artificial Sequence: Synthetic primer
aattcgcagagctcggtaccctgaagacaagggtttcgacatt

SEQ ID NO: 302 - DNA, 23 bp, Artificial Sequence
  Description of Artificial Sequence: Synthetic primer
cggacttttcacctctttctctg

SEQ ID NO: 303 - DNA, 24 bp, Artificial Sequence
  Description of Artificial Sequence: Synthetic primer
cactgacgagtttgtcatcaacac

SEQ ID NO: 304 - DNA, 48 bp, Artificial Sequence
  Description of Artificial Sequence: Synthetic primer
ccgaaacaaccgtagatacctttaaggtatcggtgtccttcttcttga

SEQ ID NO: 305 - DNA, 48 bp, Artificial Sequence
  Description of Artificial Sequence: Synthetic primer
tcaagaagaaggacaccgataccttaaaggtatctacggttgtttcgg

SEQ ID NO: 306 - DNA, 40 bp, Artificial Sequence
  Description of Artificial Sequence: Synthetic primer
acaagtaagcggcagccaagggtaccgagctctgcgaatt

SEQ ID NO: 307 - DNA, 40 bp, Artificial Sequence
  Description of Artificial Sequence: Synthetic primer
aattcgcagagctcggtacccttggctgccgcttacttgt

SEQ ID NO: 308 - DNA, 20 bp, Artificial Sequence
  Description of Artificial Sequence: Synthetic primer
accaatgtctctggccaagc

SEQ ID NO: 309 - DNA, 21 bp, Artificial Sequence
  Description of Artificial Sequence: Synthetic primer
ttccgcttaatggagtccaaa

SEQ ID NO: 310 - DNA, 20 bp, Artificial Sequence
  Description of Artificial Sequence: Synthetic primer
taaacgttgggcaaccttgg

SEQ ID NO: 311 - DNA, 21 bp, Artificial Sequence
  Description of Artificial Sequence: Synthetic primer
cagactcaaaggcaaccactt

SEQ ID NO: 312 - DNA, 52 bp, Artificial Sequence
  Description of Artificial Sequence: Synthetic primer
tttattggagctccaattgtaatatttcgggatgacatacttgacggaggtg

SEQ ID NO: 313 - DNA, 47 bp, Artificial Sequence
  Description of Artificial Sequence: Synthetic primer
aaacaaccataaagctgcttgacaaagaacgaagaagaaaccaaggc

SEQ ID NO: 314 - DNA, 25 bp, Artificial Sequence
  Description of Artificial Sequence: Synthetic primer
gcaacaattcaatacctttcaaacc

SEQ ID NO: 315 - DNA, 52 bp, Artificial Sequence
  Description of Artificial Sequence: Synthetic primer
cacctccgtcaagtatgtcatcccgaaatattacaattggagctccaataaa

SEQ ID NO: 316 - DNA, 47 bp, Artificial Sequence
  Description of Artificial Sequence: Synthetic primer
gccttggtttcttcttcgttctttgtcaagcagctttatggttgttt

SEQ ID NO: 317 - DNA, 20 bp, Artificial Sequence
  Description of Artificial Sequence: Synthetic primer
acaagagacagggcggcaaa

SEQ ID NO: 318 - DNA, 51 bp, Artificial Sequence
  Description of Artificial Sequence: Synthetic primer
tttattggagctccaattgtaatatttcggcggtcaaagtcttgacattgg

SEQ ID NO: 319 - DNA, 46 bp, Artificial Sequence
  Description of Artificial Sequence: Synthetic primer
aaacaaccataaagctgcttgacaaacaaaagatcttctgggctgc

SEQ ID NO: 320 - DNA, 21 bp, Artificial Sequence
  Description of Artificial Sequence: Synthetic primer
tttcaaccagatttcaccctg

SEQ ID NO: 321 - DNA, 51 bp, Artificial Sequence
  Description of Artificial Sequence: Synthetic primer
ccaatgtcaagactttgaccgccgaaatattacaattggagctccaataaa

SEQ ID NO: 322 - DNA, 46 bp, Artificial Sequence
  Description of Artificial Sequence: Synthetic primer
gcagcccagaagatcttttgtttgtcaagcagctttatggttgttt

SEQ ID NO: 323 - DNA, 30 bp, Artificial Sequence
  Description of Artificial Sequence: Synthetic primer
gatttacaccgcgggtaccaccggtttgcc

SEQ ID NO: 324 - DNA, 30 bp, Artificial Sequence
  Description of Artificial Sequence: Synthetic primer
ggcaaaccggtggtacccgcggtgtaaatc

SEQ ID NO: 325 - DNA, 42 bp, Artificial Sequence
  Description of Artificial Sequence: Synthetic primer
cacacagctcttccataatgtcaggattagaaatagccgctg

SEQ ID NO: 326 - DNA, 39 bp, Artificial Sequence
  Description of Artificial Sequence: Synthetic primer
cacacagctcttccataatgcccgatatgacaaacgaat

SEQ ID NO: 327 - DNA, 49 bp, Artificial Sequence
  Description of Artificial Sequence: Synthetic primer
cacacagctcttccctctcttctattcaacaccagcttcgaagtccttt

SEQ ID NO: 328 - DNA, 53 bp, Artificial Sequence
  Description of Artificial Sequence: Synthetic primer
cacacagctcttccctctcttctattcctacaatttggctttaccggtacaaa

SEQ ID NO: 329 - DNA, 40 bp, Artificial Sequence
  Description of Artificial Sequence: Synthetic primer
cacacagctcttccataatgcatgcattattctcaaaatc

SEQ ID NO: 330 - DNA, 47 bp, Artificial Sequence
  Description of Artificial Sequence: Synthetic primer
cacacagctcttccctctcttctattctcatttggaggtatccaaga

SEQ ID NO: 331 - DNA, 37 bp, Artificial Sequence
  Description of Artificial Sequence: Synthetic primer
cacacagctcttccataatgtcaattccaactactca

SEQ ID NO: 332 - DNA, 47 bp, Artificial Sequence
  Description of Artificial Sequence: Synthetic primer
cacacagctcttccctctcttctattcttacttagagttgtccaaga

SEQ ID NO: 333 - DNA, 37 bp, Artificial Sequence
  Description of Artificial Sequence: Synthetic primer
cacacagctcttccataatgtcaattccaactaccca

SEQ ID NO: 334 - DNA, 47 bp, Artificial Sequence
  Description of Artificial Sequence: Synthetic primer
cacacagctcttccctctcttctattcctacttggcagtgtcaacaa

SEQ ID NO: 335 - DNA, 37 bp, Artificial Sequence
  Description of Artificial Sequence: Synthetic primer
cacacagctcttccataatgactgttgacgcttcttc

SEQ ID NO: 336 - DNA, 47 bp, Artificial Sequence
  Description of Artificial Sequence: Synthetic primer
cacacagctcttccctctcttctattcctaattgccaaaagctttgt

SEQ ID NO: 337 - DNA, 37 bp, Artificial Sequence
  Description of Artificial Sequence: Synthetic primer
cacacagctcttccataatgtcacttgtcctcaagcg

SEQ ID NO: 338 - DNA, 47 bp, Artificial Sequence
  Description of Artificial Sequence: Synthetic primer
cacacagctcttccctctcttctattcttatgggtggaagacaactc

SEQ ID NO: 339 - DNA, 37 bp, Artificial Sequence
  Description of Artificial Sequence: Synthetic primer
cacacagctcttccataatgtcaactcaatcaggtta

SEQ ID NO: 340 - DNA, 47 bp, Artificial Sequence
  Description of Artificial Sequence: Synthetic primer
cacacagctcttccctctcttctattcctacaacttacttggtctaa

SEQ ID NO: 341 - DNA, 37 bp, Artificial Sequence
  Description of Artificial Sequence: Synthetic primer
cacacagctcttccataatgtcattatcaggaaagac

SEQ ID NO: 342 - DNA, 47 bp, Artificial Sequence
  Description of Artificial Sequence: Synthetic primer
cacacagctcttccctctcttctattcttaacgagcagtgaaaccac

SEQ ID NO: 343 - DNA, 37 bp, Artificial Sequence
  Description of Artificial Sequence: Synthetic primer
cacacagctcttccataatgagtaagtcatacaagtt

SEQ ID NO: 344 - DNA, 48 bp, Artificial Sequence
  Description of Artificial Sequence: Synthetic primer
cacacagctcttccctctcttctattcctacaaagaggcaccaataaa

SEQ ID NO: 345 - DNA, 37 bp, Artificial Sequence
  Description of Artificial Sequence: Synthetic primer
cacacagctcttccataatgtccccaccatctaaatt

SEQ ID NO: 346 - DNA, 47 bp, Artificial Sequence
  Description of Artificial Sequence: Synthetic primer
cacacagctcttccctctcttctattctctattgcttattagtgatg

SEQ ID NO: 347 - DNA, 47 bp, Artificial Sequence
  Description of Artificial Sequence: Synthetic primer
cacacagctcttccctctcttctattctcaccacatgttgacaacag

SEQ ID NO: 348 - DNA, 60 bp, Artificial Sequence
  Description of Artificial Sequence: Synthetic primer
cacacagctcttccataatgtctgaatcaaccgttggaaaaccaatcacctgtaaagccg

SEQ ID NO: 349 - DNA, 48 bp, Artificial Sequence
  Description of Artificial Sequence: Synthetic primer
cacacagctcttccataatgtctgctaatatcccaaaaactcaaaaag

SEQ ID NO: 350 - DNA, 50 bp, Artificial Sequence
  Description of Artificial Sequence: Synthetic primer
gttaggcttcaacgctattcaaatattgaaaagctacaattgttacattg

SEQ ID NO: 351 - DNA, 50 bp, Artificial Sequence
  Description of Artificial Sequence: Synthetic primer
caatgtaacaattgtagcttttcaatatttgaatagcgttgaagcctaac

SEQ ID NO: 352 - DNA, 37 bp, Artificial Sequence
  Description of Artificial Sequence: Synthetic primer
cacacagctcttccataatgtccgttccaactactca

SEQ ID NO: 353 - DNA, 47 bp, Artificial Sequence
  Description of Artificial Sequence: Synthetic primer
cacacagctcttccctctcttctattcctactttgacgtatcaacga

SEQ ID NO: 354 - DNA, 25 bp, Artificial Sequence
  Description of Artificial Sequence: Synthetic primer
gatattattccaccttcccttcatt

SEQ ID NO: 355 - DNA, 26 bp, Artificial Sequence
  Description of Artificial Sequence: Synthetic primer
ccgttaaacaaaaatcagtctgtaaa

SEQ ID NO: 356 - DNA, 27 bp, Artificial Sequence
  Description of Artificial Sequence: Synthetic primer
ggtttcataagccttttcacggtcttc

SEQ ID NO: 357 - DNA, 27 bp, Artificial Sequence
  Description of Artificial Sequence: Synthetic primer
gagttgacaaagttcaagtttgctgtc

SEQ ID NO: 358 - DNA, 36 bp, Artificial Sequence
  Description of Artificial Sequence: Synthetic primer
agtcagtactcgagttaaacaccagcttcgaagtcc

SEQ ID NO: 359 - DNA, 20 bp, Artificial Sequence
  Description of Artificial Sequence: Synthetic primer
cgacgggtacaacgagaatt

SEQ ID NO: 360 - DNA, 20 bp, Artificial Sequence
  Description of Artificial Sequence: Synthetic primer
agacgaagccgttcttcaag

SEQ ID NO: 361 - DNA, 39 bp, Artificial Sequence
  Description of Artificial Sequence: Synthetic primer
cacacactgcagttttctttcgttctcgttccgtccttc

SEQ ID NO: 362 - DNA, 68 bp, Artificial Sequence
  Description of Artificial Sequence: Synthetic primer
cacacatctagacccgggctcttctcctaggggttattttatgtgatgattattatgatatagtagtc

SEQ ID NO: 363 - DNA, 70 bp, Artificial Sequence
  Description of Artificial Sequence: Synthetic primer
cccgaaatattacaattggagctccaataaatattgtaataaataggtctatatacatacactaagcttc

SEQ ID NO: 364 - DNA, 49 bp, Artificial Sequence
  Description of Artificial Sequence: Synthetic primer
caatacaattctcgttgtacccgtcgagacgaagccgttcttcaaggtg

SEQ ID NO: 365 - DNA, 26 bp, Artificial Sequence
  Description of Artificial Sequence: Synthetic primer
cgacgggtacaacgagaattgtattg

SEQ ID NO: 366 - DNA, 48 bp, Artificial Sequence
  Description of Artificial Sequence: Synthetic primer
ttgtcaagcagctttatggttgtttagacgaagccgttcttcaaggtg

SEQ ID NO: 367 - DNA, 25 bp, Artificial Sequence
  Description of Artificial Sequence: Synthetic primer
ttgtcaagcagctttatggttgttt

SEQ ID NO: 368 - DNA, 25 bp, Artificial Sequence
  Description of Artificial Sequence: Synthetic primer
cccgaaatattacaattggagctcc

SEQ ID NO: 369 - DNA, 42 bp, Artificial Sequence
  Description of Artificial Sequence: Synthetic primer
cacacactgcagctagcaaaggcttgatcagagaaagcaaca

SEQ ID NO: 370 - DNA, 55 bp, Artificial Sequence
  Description of Artificial Sequence: Synthetic primer
cacacatctagacccgggctcttctgattgtagggcgttggtgagtaagaacatt

SEQ ID NO: 371 - DNA, 53 bp, Artificial Sequence
  Description of Artificial Sequence: Synthetic primer
gagcccgggtctagatgtgtgctcttcctggaaatcgaactcgacggtcacaa

SEQ ID NO: 372 - DNA, 78 bp, Artificial Sequence
  Description of Artificial Sequence: Synthetic primer
cacacacatatgaattcgccaacatgttggttactctatgcatcgtacttggtatattgatgttgttaatagactata

SEQ ID NO: 373 - DNA, 63 bp, Artificial Sequence
  Description of Artificial Sequence: Synthetic primer
gagcccgggtctagatgtgtgctcttccgctccaggcttgttatgactctagagagaagtgtg

SEQ ID NO: 374 - DNA, 62 bp, Artificial Sequence
  Description of Artificial Sequence: Synthetic primer
cacacacatatgaattcggtcgggttttgaccttggatatgaaactcaaaaatcatcaaatt

SEQ ID NO: 375 - DNA, 45 bp, Artificial Sequence
  Description of Artificial Sequence: Synthetic primer
cacacatctagacccgggctcttctggctgcgttgtgtatgggtt

SEQ ID NO: 376 - DNA, 32 bp, Artificial Sequence
  Description of Artificial Sequence: Synthetic primer
cacacactgcaggaggatgaagaagacgaaga

SEQ ID NO: 377 - DNA, 21 bp, Artificial Sequence
  Description of Artificial Sequence: Synthetic primer
ttccgcttaatggagtccaaa

SEQ ID NO: 378 - DNA, 40 bp, Artificial Sequence
  Description of Artificial Sequence: Synthetic primer
atgatctgccatgccgaactagacgaagccgttcttcaag

SEQ ID NO: 379 - DNA, 40 bp, Artificial Sequence
  Description of Artificial Sequence: Synthetic primer
cttgaagaacggcttcgtctagttcggcatggcagatcat

SEQ ID NO: 380 - DNA, 20 bp, Artificial Sequence
  Description of Artificial Sequence: Synthetic primer
taaacgttgggcaaccttgg

SEQ ID NO: 381 - DNA, 37 bp, Artificial Sequence
  Description of Artificial Sequence: Synthetic primer
aagcttttaattaacgttggggtaaaacaacagagag

SEQ ID NO: 382 - DNA, 47 bp, Artificial Sequence
  Description of Artificial Sequence: Synthetic primer
ggatccgcatgcggccggccgtcgtgaagatttgaacaatgttagtg

SEQ ID NO: 383 - DNA, 53 bp, Artificial Sequence
  Description of Artificial Sequence: Synthetic primer
ggatccgagctcgcggccgcgaatagaagagagtgactcttttgataagagtc

SEQ ID NO: 384 - DNA, 42 bp, Artificial Sequence
  Description of Artificial Sequence: Synthetic primer
gaattcttaattaacattgtttggagaaagaagaagaagaag

SEQ ID NO: 385 - DNA, 41 bp, Artificial Sequence
  Description of Artificial Sequence: Synthetic primer
ggatccgagctcgcggccgcccgaaacaaccataaagctgc

SEQ ID NO: 386 - DNA, 58 bp, Artificial Sequence
  Description of Artificial Sequence: Synthetic primer
aacagcggccgctaaatattgtaataaataggtctatatacatacactaagcttctag

SEQ ID NO: 387 - DNA, 34 bp, Artificial Sequence
  Description of Artificial Sequence: Synthetic primer
aacagcggccgcagacgaagccgttcttcaaggt

SEQ ID NO: 388 - DNA, 60 bp, Artificial Sequence
  Description of Artificial Sequence: Synthetic primer
aggaatacagatttatacaataaattgccatacaagtcacgtgagatatctcatccattc

SEQ ID NO: 389 - DNA, 60 bp, Artificial Sequence
  Description of Artificial Sequence: Synthetic primer
gaatggatgagatatctcacgtgacttgtatggcaatttattgtataaatctgtattcct

SEQ ID NO: 390 - DNA, 40 bp, Artificial Sequence
  Description of Artificial Sequence: Synthetic primer
acaggatcctagaggttgttctagcaaataaagtgtttca

SEQ ID NO: 391 - DNA, 33 bp, Artificial Sequence
  Description of Artificial Sequence: Synthetic primer
acagcggccgccgacgacgtgagtcagaacttg

SEQ ID NO: 392 - DNA, 33 bp, Artificial Sequence
  Description of Artificial Sequence: Synthetic primer
acaggccggcccgacgacgtgagtcagaacttg

SEQ ID NO: 393 - DNA, 38 bp, Artificial Sequence
  Description of Artificial Sequence: Synthetic primer
acaggatcccatcaagatcatctatggggataattacg

SEQ ID NO: 394 - DNA, 31 bp, Artificial Sequence
  Description of Artificial Sequence: Synthetic primer
acaggccggcccgacgacgtgagccagaact

SEQ ID NO: 395 - DNA, 40 bp, Artificial Sequence
  Description of Artificial Sequence: Synthetic primer
aagcttttaattaaagataatcacaggggtagagaccttg

SEQ ID NO: 396 - DNA, 48 bp, Artificial Sequence
  Description of Artificial Sequence: Synthetic primer
ggatccgcatgcggccggccgatagcgtggtatgaatgaataagtgtg

SEQ ID NO: 397 - DNA, 51 bp, Artificial Sequence
  Description of Artificial Sequence: Synthetic primer
ggatccgagctcgcggccgcgagcactaggttttgataatttggttcttac

SEQ ID NO: 398 - DNA, 36 bp, Artificial Sequence
  Description of Artificial Sequence: Synthetic primer
gaattcttaattaacggcgaagaacatagtgtgatg

SEQ ID NO: 399 - DNA, 34 bp, Artificial Sequence
  Description of Artificial Sequence: Synthetic primer
cacacagcatgcgagctccaattgtaatatttcg

SEQ ID NO: 400 - DNA, 34 bp, Artificial Sequence; identical to SEQ ID NO: 399
  Description of Artificial Sequence: Synthetic primer

SEQ ID NO: 401 - DNA, 43 bp, Artificial Sequence
  Description of Artificial Sequence: Synthetic primer
cacacacccggggtcgacctaaattcgcaactatcaactaagg

SEQ ID NO: 402 - DNA, 43 bp, Artificial Sequence; identical to SEQ ID NO: 401
  Description of Artificial Sequence: Synthetic primer

SEQ ID NO: 403 - DNA, 36 bp, Artificial Sequence
  Description of Artificial Sequence: Synthetic primer
cacacacccggggagctccaattgtaatatttcggg

SEQ ID NO: 404 - DNA, 36 bp, Artificial Sequence; identical to SEQ ID NO: 403
  Description of Artificial Sequence: Synthetic primer

SEQ ID NO: 405 - DNA, 40 bp, Artificial Sequence
  Description of Artificial Sequence: Synthetic primer
cacacagcggccgcgtcgacctaaattcgcaactatcaac

SEQ ID NO: 406 - DNA, 40 bp, Artificial Sequence; identical to SEQ ID NO: 405
  Description of Artificial Sequence: Synthetic primer

SEQ ID NO: 407 - DNA, 21 bp, Artificial Sequence
  Description of Artificial Sequence: Synthetic primer
gtggcagcgtacaacttaccg

SEQ ID NO: 408 - DNA, 21 bp, Artificial Sequence
  Description of Artificial Sequence: Synthetic primer
ctccaacgtcagaatcccaag

SEQ ID NO: 409 - DNA, 42 bp, Artificial Sequence
  Description of Artificial Sequence: Synthetic primer
cttgggattctgacgttggagcgacgggtacaacgagaattg

SEQ ID NO: 410 - DNA, 20 bp, Artificial Sequence
  Description of Artificial Sequence: Synthetic primer
cgaagccgttcttcaaggtg

SEQ ID NO: 411 - DNA, 44 bp, Artificial Sequence
  Description of Artificial Sequence: Synthetic primer
caccttgaagaacggcttcgccgttatcgataccatctctaccc

SEQ ID NO: 412 - DNA, 26 bp, Artificial Sequence
  Description of Artificial Sequence: Synthetic primer
cgttagtgtatcacaaggtcctgacc

SEQ ID NO: 413 - DNA, 25 bp, Artificial Sequence
  Description of Artificial Sequence: Synthetic primer
acaagtgcacgtactgtgacaaggc

SEQ ID NO: 414 - DNA, 49 bp, Artificial Sequence
  Description of Artificial Sequence: Synthetic primer
ggagctccaattgtaatatttcggcgttacggtcgatagcaaaggggat

SEQ ID NO: 415 - DNA, 53 bp, Artificial Sequence
  Description of Artificial Sequence: Synthetic primer
aaacaaccataaagctgcttgacaaaataccgtctcagccatcatctacatcc

SEQ ID NO: 416 - DNA, 36 bp, Artificial Sequence
  Description of Artificial Sequence: Synthetic primer
tcaacaccgatctaattggcggcaactgtgttcctg

SEQ ID NO: 417 - DNA, 49 bp, Artificial Sequence
  Description of Artificial Sequence: Synthetic primer
atcccctttgctatcgaccgtaacgccgaaatattacaattggagctcc

SEQ ID NO: 418 - DNA, 53 bp, Artificial Sequence
  Description of Artificial Sequence: Synthetic primer
ggatgtagatgatggctgagacggtattttgtcaagcagctttatggttgttt

SEQ ID NO: 419 - DNA, 26 bp, Artificial Sequence
  Description of Artificial Sequence: Synthetic primer
tgtaccctcaaccataccctgtgttt

SEQ ID NO: 420 - DNA, 49 bp, Artificial Sequence
  Description of Artificial Sequence: Synthetic primer
ggagctccaattgtaatatttcggtgatttggacggtttgggacatttt

SEQ ID NO: 421 - DNA, 50 bp, Artificial Sequence
  Description of Artificial Sequence: Synthetic primer
aaacaaccataaagctgcttgacaacaaacagggtgtttagccaaccaaa

SEQ ID NO: 422 - DNA, 25 bp, Artificial Sequence
  Description of Artificial Sequence: Synthetic primer
cgggtgtcgagtttgtagatgtctg

SEQ ID NO: 423 - DNA, 49 bp, Artificial Sequence
  Description of Artificial Sequence: Synthetic primer
aaaatgtcccaaaccgtccaaatcaccgaaatattacaattggagctcc

SEQ ID NO: 424 - DNA, 50 bp, Artificial Sequence
  Description of Artificial Sequence: Synthetic primer
tttggttggctaaacaccctgtttgttgtcaagcagctttatggttgttt

SEQ ID NO: 425 - DNA, 47 bp, Artificial Sequence
  Description of Artificial Sequence: Synthetic primer
cacacagctcttcagccatgctcgatcagatcttacattactggtac

SEQ ID NO: 426 - DNA, 41 bp, Artificial Sequence
  Description of Artificial Sequence: Synthetic primer
cacacagctcttcgagcctatgacatcttgacgtgtgcacc

SEQ ID NO: 427 - DNA, 24 bp, Artificial Sequence
  Description of Artificial Sequence: Synthetic primer
atgcctaccgaacttcaaaaagaa

SEQ ID NO: 428 - DNA, 24 bp, Artificial Sequence
  Description of Artificial Sequence: Synthetic primer
aactcgtcagtgtcttcgtcaaaa

SEQ ID NO: 429 - DNA, 45 bp, Artificial Sequence
  Description of Artificial Sequence: Synthetic primer
ttttgacgaagacactgacgagttcgacgggtacaacgagaactg

SEQ ID NO: 430 - DNA, 42 bp, Artificial Sequence
  Description of Artificial Sequence: Synthetic primer
caccttgaagaacggcttcggacaagggtttcgacattaccg

SEQ ID NO: 431 - DNA, 26 bp, Artificial Sequence
  Description of Artificial Sequence: Synthetic primer
tattaactggacaagatttcagcagc

SEQ ID NO: 432 - DNA, 32 bp, Artificial Sequence
  Description of Artificial Sequence: Synthetic primer
ggcctgactggcctaatcaggcggctccttcc

SEQ ID NO: 433 - DNA, 33 bp, Artificial Sequence
  Description of Artificial Sequence: Synthetic primer
ggcctggaaggccacggcgggttgtttgagttg

SEQ ID NO: 434 - DNA, 40 bp, Artificial Sequence
  Description of Artificial Sequence: Synthetic primer
ggccttcctggccgaggatgaagaagacgaagacgaattg

SEQ ID NO: 435 - DNA, 32 bp, Artificial Sequence
  Description of Artificial Sequence: Synthetic primer
ggcctgagaggccggtcgggttttgaccttgg

SEQ ID NO: 436 - DNA, 33 bp, Artificial Sequence
  Description of Artificial Sequence: Synthetic primer
ggcctctctggcctgaattttctcagggccgtg

SEQ ID NO: 437 - DNA, 39 bp, Artificial Sequence
  Description of Artificial Sequence: Synthetic primer
ggccttgcaggcctctgtcttgtttgagttgatcgactc

SEQ ID NO: 438 - DNA, 38 bp, Artificial Sequence
  Description of Artificial Sequence: Synthetic primer
gagctcggccggccatggctatgctcagtcaaccaaac

SEQ ID NO: 439 - DNA, 38 bp, Artificial Sequence
  Description of Artificial Sequence: Synthetic primer
aagcttggccggccgcagatggtaagggttctacttgg

SEQ ID NO: 440 - DNA, 38 bp, Artificial Sequence
  Description of Artificial Sequence: Synthetic primer
gaattcggccggccacaagtgcacgtactgtgacaagg

SEQ ID NO: 441 - DNA, 50 bp, Artificial Sequence
  Description of Artificial Sequence: Synthetic primer
ggcccgaatgcggatccccggtctggcccgttacggtcgatagcaaaggg

SEQ ID NO: 442 - DNA, 61 bp, Artificial Sequence
  Description of Artificial Sequence: Synthetic primer
ggatccgcattcgggccagcacggccgcggccgcaataccgtctcagccatcatctacatc

SEQ ID NO: 443 - DNA, 39 bp, Artificial Sequence
  Description of Artificial Sequence: Synthetic primer
tagcgcatgcggccggcctcaacaccgatctaattggcg

SEQ ID NO: 444 - DNA, 51 bp, Artificial Sequence
  Description of Artificial Sequence: Synthetic primer
ggcccgaatgcggatccccggtctggcccctccttcttgttggaccaaaag

SEQ ID NO: 445 - DNA, 57 bp, Artificial Sequence
  Description of Artificial Sequence: Synthetic primer
ggatccgcattcgggccagcacggccgcggccgcccattggtgctcaaagagtcatc

SEQ ID NO: 446 - DNA, 26 bp, Artificial Sequence
  Description of Artificial Sequence: Synthetic primer
gggccagaccggccggatccgcattc

SEQ ID NO: 447 - DNA, 26 bp, Artificial Sequence
  Description of Artificial Sequence: Synthetic primer
gaatgcggatccggccggtctggccc

SEQ ID NO: 448 - DNA, 59 bp, Artificial Sequence
  Description of Artificial Sequence: Synthetic primer
cacacagctcttccataatgtatgcgaccaacgaaaaaaaaattgaaatctccgaccta

SEQ ID NO: 449 - DNA, 49 bp, Artificial Sequence
  Description of Artificial Sequence: Synthetic primer
cacacagctcttccctctcttctattctcagcttttgccgccactcaag

SEQ ID NO: 450 - DNA, 55 bp, Artificial Sequence
  Description of Artificial Sequence: Synthetic primer
cacacacctaggatgtcaagctcagatgaaggagatcacactcctgagttacaac

SEQ ID NO: 451 - DNA, 55 bp, Artificial Sequence
  Description of Artificial Sequence: Synthetic primer
cacacatctagactattggttcatcatgttaaacaaagaatgaatgtcctcgtcc

SEQ ID NO: 452 - DNA, 60 bp, Artificial Sequence
  Description of Artificial Sequence: Synthetic primer
cacacagctcttcaatcatgtcaagctcagatgaaggagatcacactcctgagttacaac

SEQ ID NO: 453 - DNA, 59 bp, Artificial Sequence
  Description of Artificial Sequence: Synthetic primer
cacacagctcttctccactattggttcatcatgttaaacaaagaatgaatgtcctcgtc

SEQ ID NO: 454 - DNA, 25 bp, Artificial Sequence
  Description of Artificial Sequence: Synthetic primer
ttccgcttaatggagtccaaaaaga

SEQ ID NO: 455 - DNA, 50 bp, Artificial Sequence
  Description of Artificial Sequence: Synthetic primer
tcccgaaatattacaattggagctctagacgaagccgttcttcaaggtgt

SEQ ID NO: 456 - DNA, 50 bp, Artificial Sequence
  Description of Artificial Sequence: Synthetic primer
acaccttgaagaacggcttcgtctagagctccaattgtaatatttcggga

SEQ ID NO: 457 - DNA, 50 bp, Artificial Sequence
  Description of Artificial Sequence: Synthetic primer
attctcgttgtacccgtcgcatatggtcgacctaaattcgcaactatcaa

SEQ ID NO: 458 - DNA, 50 bp, Artificial Sequence
  Description of Artificial Sequence: Synthetic primer
ttgatagttgcgaatttaggtcgaccatatgcgacgggtacaacgagaat

SEQ ID NO: 459 - DNA, 37 bp, Artificial Sequence
  Description of Artificial Sequence: Synthetic primer
taaacgttgggcaaccttggaggggtgtgctgatgcc

SEQ ID NO: 460 - DNA, 31 bp, Artificial Sequence
  Description of Artificial Sequence: Synthetic primer
ggcctctctggccggtcgggttttgaccttg

SEQ ID NO: 461 - DNA, 40 bp, Artificial Sequence
  Description of Artificial Sequence: Synthetic primer
ggcctacgaggccgaggatgaagaagacgaagacgaattg

SEQ ID NO: 462 - DNA, 41 bp, Artificial Sequence
  Description of Artificial Sequence: Synthetic primer
ggcctcgttggcccaattgtaatatttcgggagaaatatcg

SEQ ID NO: 463 - DNA, 39 bp, Artificial Sequence
  Description of Artificial Sequence: Synthetic primer
ggccttgcaggccgtcgacctaaattcgcaactatcaac

SEQ ID NO: 464 - DNA, 41 bp, Artificial Sequence
  Description of Artificial Sequence: Synthetic primer
cacctcgctcttccagctgtcatgtctattcaatgcttcga

SEQ ID NO: 465 - DNA, 38 bp, Artificial Sequence
  Description of Artificial Sequence: Synthetic primer
cacacagcatgctaatgtttatatcgttgacggtgaaa

SEQ ID NO: 466 - DNA, 45 bp, Artificial Sequence
  Description of Artificial Sequence: Synthetic primer
cacaaagcggaagagcaaattttgtattctcagtaggatttcatc

SEQ ID NO: 467 - DNA, 38 bp, Artificial Sequence
  Description of Artificial Sequence: Synthetic primer
cacacagcatgcaaacttaagggtgttgtagatatccc

SEQ ID NO: 468 - DNA, 44 bp, Artificial Sequence
  Description of Artificial Sequence: Synthetic primer
cacacacccgggatcgacagtcgattacgtaatccatattattt

SEQ ID NO: 469 - DNA, 38 bp, Artificial Sequence; identical to SEQ ID NO: 467
  Description of Artificial Sequence: Synthetic primer

SEQ ID NO: 470 - DNA, 33 bp, Artificial Sequence
  Description of Artificial Sequence: Synthetic primer
cacacagagctcacagtcgattacgtaatccat

SEQ ID NO: 471 - DNA, 34 bp, Artificial Sequence
  Description of Artificial Sequence: Synthetic primer
cacatctagagcatgcaaacttaagggtgttgta

SEQ ID NO: 472 - DNA, 20 bp, Artificial Sequence
  Description of Artificial Sequence: Synthetic primer
ttaatgccttctcaagacaa

SEQ ID NO: 473 - DNA, 20 bp, Artificial Sequence
  Description of Artificial Sequence: Synthetic primer
ggttttcccagtcacgacgt

SEQ ID NO: 474 - DNA, 25 bp, Artificial Sequence
  Description of Artificial Sequence: Synthetic primer
ccttgctaattttcttctgtatagc

SEQ ID NO: 475 - DNA, 20 bp, Artificial Sequence
  Description of Artificial Sequence: Synthetic primer
ttctcgttgtacccgtcgca

SEQ ID NO: 476 - DNA, 20 bp, Artificial Sequence
  Description of Artificial Sequence: Synthetic primer
cacacaacttcagagttgcc

SEQ ID NO: 477 - DNA, 20 bp, Artificial Sequence
  Description of Artificial Sequence: Synthetic primer
tcgccacctctgacttgagc

SEQ ID NO: 478 - DNA, 20 bp, Artificial Sequence
  Description of Artificial Sequence: Synthetic probe
aattgaacatcagaagagga

SEQ ID NO: 479 - DNA, 25 bp, Artificial Sequence
  Description of Artificial Sequence: Synthetic probe
cctgaaatttccaaatggtgtctaa

SEQ ID NO: 480 - DNA, 20 bp, Artificial Sequence
  Description of Artificial Sequence: Synthetic probe
ttttttgtgcgcaagtacac

SEQ ID NO: 481 - DNA, 20 bp, Artificial Sequence
  Description of Artificial Sequence: Synthetic probe
caacttgacgtgagaaacct

SEQ ID NO: 482 - DNA, 20 bp, Artificial Sequence
  Description of Artificial Sequence: Synthetic probe
agatgctcgttttacaccct

SEQ ID NO: 483 - DNA, 20 bp, Artificial Sequence
  Description of Artificial Sequence: Synthetic probe
acacagctttgatgttctct

We claim:

1. A genetically modified yeast, comprising:
   at least one genetic modification that deletes one or more nucleotides of a nucleic acid sequence encoding POX4, POX5, or POX4 and POX5;
   at least one genetic modification that inserts a heterologous polynucleotide or a heterologous promoter, wherein the at least one genetic modification increases at least one activity selected from the group consisting of: monooxygenase activity, monooxygenase reductase activity, thioesterase activity, acyltransferase activity, isocitrate dehydrogenase activity, glyceraldehyde-3-phosphate dehydrogenase activity, glucose-6-phosphate dehydrogenase activity, acyl-coA oxidase activity, fatty alcohol oxidase activity, acyl-CoA hydrolase activity, alcohol dehydrogenase activity, peroxisomal biogenesis factor activity, fatty aldehyde dehydrogenase activity, CTF, UTR, and FAT1; and
   at least one genetic modification that deletes one or more nucleotides of a nucleic acid sequence encoding *Candida* MIG1;
   wherein the genetically modified yeast produces a higher yield of a diacid as compared to corresponding yeast not comprising said genetic modifications when cultured with a feedstock comprising at least one fatty acid or an ester thereof.

2. The genetically modified yeast of claim 1, comprising at least one genetic modification that increases one or more monooxygenase activities selected from a *Candida* CYP52A12 monooxygenase activity, *Candida* CYP52A13 monooxygenase activity, *Candida* CYP52A14 monooxygenase activity, *Candida* CYP52A15 monooxygenase activity, *Candida* CYP52A16 monooxygenase activity, *Candida* CYP52A17 monooxygenase activity, *Candida* CYP52A18 monooxygenase activity, *Candida* CYP52A19 monooxygenase activity, *Candida* CYP52A20 monooxygenase activity, *Candida* CYP52D2 monooxygenase activity and *Candida* BM3 monooxygenase activity.

3. The genetically modified yeast of claim 1, comprising at least one genetic modification that increases one or more monooxygenase reductase activities selected from the group consisting of: CPRA monooxygenase reductase activity, CPRB monooxygenase reductase activity and CPR750 monooxygenase reductase activity.

4. The genetically modified yeast of claim 1, comprising at least one genetic modification that increases at least one glucose-6-phosphate dehydrogenase activity selected from the group consisting of: a ZWF1 glucose-6-phosphate dehydrogenase activity and ZWF2 glucose-6-phosphate dehydrogenase activity.

5. The genetically modified yeast of claim 1, comprising at least one genetic modification that increases one or more fatty alcohol oxidase activities selected from the group consisting of: FAO1 fatty alcohol oxidase activity, FAO2A fatty alcohol oxidase activity, FAO2B fatty alcohol oxidase activity, FAO13 fatty alcohol oxidase activity, FAO17 fatty alcohol oxidase activity, FAO18 fatty alcohol oxidase activity and FAO20 fatty alcohol oxidase activity.

6. The genetically modified yeast of claim 1, comprising at least one genetic modification that increases one or more alcohol dehydrogenase activities selected from the group consisting of: ADH1 alcohol dehydrogenase activity, ADH2 alcohol dehydrogenase activity, ADH3 alcohol dehydrogenase activity, ADH4 alcohol dehydrogenase activity, ADH5 alcohol dehydrogenase activity, ADH7 alcohol dehydrogenase activity, ADH8 alcohol dehydrogenase activity and SFA alcohol dehydrogenase activity.

7. The genetically modified yeast of claim 1, comprising at least one genetic modification that increases one or more acyl-CoA hydrolase activities selected from the group consisting of: ACH-A acyl-CoA hydrolase activity and ACH-B acyl-CoA hydrolase activity.

8. The genetically modified yeast of claim 1, comprising at least one genetic modification that increases one or more acyltransferase activities selected from the group consisting of: acyl-CoA sterol acyltransferase activity, diacylglycerol acyltransferase activity, phospholipid:diacylglycerol acyltransferase activity, ARE1 acyl-CoA sterol acyltransferase activity, ARE2 acyl-CoA sterol acyltransferase activity, DGA1 diacylglycerol acyltransferase activity, and LRO1 phospholipid:diacylglycerol acyltransferase activity.

9. The genetically modified yeast of claim 1, comprising at least one genetic modification that increases one or more fatty aldehyde dehydrogenase activities selected from the group consisting of: HFD 1 fatty aldehyde dehydrogenase activity and HFD2 fatty aldehyde dehydrogenase activity.

10. The genetically modified yeast of claim 1, comprising at least one genetic modification that decreases an acyl-coA synthetase activity.

11. The genetically modified yeast of claim 1, wherein the genetically modified yeast is selected from the group consisting of: a *Candida* spp. yeast, *C. tropicalis*, *C. viswanathii*, *Yarrowia* spp. yeast, *Pichia* spp. yeast, *Saccharomyces* spp. yeast, *Kluyveromyces* spp. yeast, *Y. lipolytica*, *P. pastoris*, *P. membranifaciens*, *P. kluyveri*, *P. guilliermondii*, *P. heedii*, *P. subpelliculosa*, *S. cerevisiae*, *S. bayanus*, *S. pastorianus*, *S. carlsbergensis*, *K. lactis*, and *K. marxianus*.

12. The genetically modified yeast of claim 1, wherein the genetically modified yeast produces a C4 to C24 diacid when cultured with the feedstock.

13. The genetically modified yeast of claim 1, wherein the at least one genetic modification that increases at least one activity comprises incorporating in the yeast a promoter in operable linkage with a polynucleotide that encodes a polypeptide having the activity, wherein the promoter is selected from the group consisting of: a POX4 promoter, PEX11 promoter, TEF1 promoter, PGK promoter and FAO1 promoter.

14. A method for producing a desired diacid, comprising:
   contacting a genetically modified yeast of claim 1 with a feedstock comprising at least one fatty acid or an ester thereof capable of being converted by the yeast to a diacid;
   and culturing the yeast under conditions in which the desired diacid is produced from the feedstock.

15. The method of claim 14, wherein the desired diacid is a C4 to C24 diacid.

16. An expression product comprising dodecanedioic acid obtained by the method of claim 14.

17. An expression product comprising dodecanedioic acid obtained by contacting the genetically modified yeast from claim 1 with a suitable feedstock; and culturing the genetically modified yeast under conditions such that said expression product comprising dodecanedioic acid is produced from said feedstock.

* * * * *